United States Patent 11,913,074 (METHODS FOR ASSESSING RISK OF DEVELOPING A VIRAL DISEASE USING A GENETIC TEST) - sequence listing, part 16

SEQ ID NO: 1714 - DNA, 50566 bp, Homo sapiens
  source 1..50566: mol_type = genomic DNA
aagaatattaattaaatgaaggttttatttcaaaattagtcttaagagtataagctgtttttgagggctgtagccagactacataatgagcggtgaaagcggctgccttcccctctcctgacaccagcaagggggaggcaccatcaccggccctgccccatcatgcatccaatgattactagcactagaagccaacggcaaaggaccccgcgcgcttgctcgtgtttaatccaggttaagctatacacgtttaaatacatgtcggaggttacatggtctcatgcagtccctgtgatggaatgactcttgctcagtgacctcctgcagcgaggctgctccaaagggcaaggttaggtagggcagagcactgcaacgagaagagaggaggggagagcggtcagaacacagttgcaggtggggacctccgagccctggatagccctagctgagagcagtcacaccagctcctgagtggtgacagcccccacttagtgcctagaataagggagagacaatggcaggtggttgctggttataataactaagcgtgtagtctccggggcctgagttcaaatcctggatccagccattactaactacatgaccttagggaaattaacttcacctttccatgcttgtttcttcatcaatacaatagaacgtacctgcgcctaccccgcagggttgttgagaggcatgtggcaagtgctgagtaaatattaatcacttgtacaaattcagtgacaactcagtggctcgtgaggggtaaagtccagccctccgactaccaaatttatataacctgtttctataatcctcctttgagaacctcctttgagaaatgtgctgctcttttaaaatctttgagtcacaaaccctttctgtggttttttgtgttttgttgttgttgttgttgttgttttgttttgtggtttgtttgtttgtttttttgagacagggtcttgctgtgtcacccaggctggatgcagtggtgtgatcacagcccccactgcagtctcagctcctgggttcaagtgatcctctcacctcagcctcctgagtagttgggactacaggcgcgcaccactacacctggctgattttttttttaattgagacgcggtctcaccatgttgcccaggctggacaagttatttttaatgtttactctaagttcctcctgctgaaatttaagattagtccttctgatccttatagaaacaatatatctcaggatttcttagctataggtcccacaaatatggtccctctgcaaccgtacatagttttgtgtgcatgcaggacaaaaaacaataaaataatagatctagacagtgagcaatcctcaaggactattaacatcacaaaaggaaagacaatcagacaatatatgtcaccccatggaagtctggaaacctataaccacctataatgtagtgcttatcaaaaaatcggaagctgtatctgatcaggcttccagttctatcagttcacaggcaataaagaagacaggagaacatattaaattacaccatggggatgaaattagcaaaaatccacaatgaggaaattctatggcacaaacaacctagtttctccaacaaatgcatttcaagaaatggaagagagaaagaaaaggggaacctatatacatcaaagagatgtaagagacatattattatctaattgcaacctactgatctttattggcccctgattcaaacaaataaactgaaaaatactttatgggaaaaacagggaatactgattggatagtcagtactaagaaactcttggctgggcacagtggctcattcctgtaatcccagcactttgggaggccaaggcgagtggatcacctgaagtcaggagtttgagaccaccctggccaacatggtgaaaccccgtctctactaaaaatacaaaaattagttgagcatggtggcaggcgcctgtaatcccagctacttaggaggctgaggcaggagaattgcttgaatccaggaggcggaggttgtagtgagctgagatcacgccattgcactccagactgggtgacagagcgagattccatctcaaaaaaaaaaaaaaagaaagaaactcttcatttgttttagttgtgaaatggtattatggctatgttttcctcaagagttcctatgttttagaaatgcataccgaaatagttatgcatgaaaactatgacagagatttgctttaaaataacatgggaggggagaagttgggtagaggcgtaaatgaaataagcctggccgggacttaataactgttgatgccagctcatcagtacctgagagtgtattatgccatttcctctactcttgtatgtacaaccagtttccataagacaaggttaaaaagttatgaaagggtgtagtcaattatgtctccagcttcctttcaagtgcttgaaaagtattaaattatcatcaggttttgtttttcccaactaaatactaagtagcccaaactctgcagaattttcacaataagtcctttgttggtttgttgctccaaggaaagtcactggtgactcgggggtgatggaatctcctcctgcggcctcctggcaacacccaaagggaaaacctattactccaaagcctttcaattgtccctgatttccctggcccctgcctggtctggtctggcatgggcaagctgggaaggttccctaactggagcaggagctccagagaaccccttctgctccaggaggcctggggctgctcttaccttttaaaatgtagtccgttagcaaagtaggcaccttctcattatcctccttcatggcaaagagaactaggaaaggagacagagagaggaactaagataccatctggtcagaggttcacttctagggccacatgacccaccagcccagagtgagagagaaatgattcaaaagaaccagacatttattgagtattgagcaaaagtctagaaggctctatcaggggtcagcatttcaggggcaagggctaaaaaactacctatccggtactatgttcactacctgggtgacaggtttagtttcagttgtaacccagaccttgagcccaggcattcaagaccagcctgggcaatatggcagaacctcatttctaattaaaaaaaaaaaagatagctgggtgtggtggcacacgcctgtagtccaaagtacttgagaggcatcacgcaatatgcccccgtaacaaacctgcacatggtgatagacgagaacacagcaagagccacagtgtttgtctctaggtagtggacctactggtgactttcttttcttttttatttttgagacaggatctcgccctgccacacaggctgaagtgcagtggcgtgttctcagctcactacagcctcaaactcctgggttcaagtaatcctccccctctcagcctcccaagtagctgagacttacaggcacgtgccactatgcccagctaattttttttttttttttagtaaagatgaggttttgccatgttgcccaggctggtcttgaactcctgggctcaagcaatcttccccacttggcctcccaaagtgacctgtgatcatgccactgcactccaacctgggcaacagagtgagactctgtctcaaaaacaagaaaaagaccatcctggacaacatagcaagactttgtctctataaaaaaaaaaaaaaaaaaaaaaaaaagaagaagaggaagaaaagaaaaataagagagagctatatgtacaagacatagttatcagtgaagaaaggttacagaacatttattaactttataattaaatgctaatgttcatagaaaaaaaatctagaacaataatacatgaaactgttaagtagttatctctgagtgtaagacaataggggatgttcttttctatgctgcatttctgtggggtctggcttttctcaatgagcatgtattacttttgtaagccaagaaaacactaaagatcaactggcactgatagctagggtcagaaggcagctgcaacagtgggattgccacttcatttcgatatccttgtcctcctttgattgattaccttgactagtttcaagacagggtaatgaaacttgaatccaagaattaggagtgagtgaggaagaaaatccaatggtggcgtgagtcagcagccaggtccagaaaaagagactcaacctgaggccattgaggggttggtttgtttctgttttatttcttctgtatctttagacatgtattcatctcagcttaagtggattctagggggtcctggtttcttctgggtttttttttttttttgagacggagtttcactcttgtcatccaggctggagtgcagtggtgcgatctcagctcactgcaacctccgcctcccgggttcaagcgattctcctgcctcagcctcccaagtagctgggattacaggcgtgcaccaccacatctggctaattttttgtatttttagtagagatgggggtttcaccatgttggccaggctggtctcaaactcctgacctcaggtgatccacccgcctcggcctcccaaagtgctgggattacaggcgtgagccaccatactcggcctgttttatttttttctgcatttttagacatgccttcatttcagcttagttgtcaagaacactttgcaactgagcataagcagactaaatgccacaccacgaagatcacgtaaaaatacaataattgctcttgccaatacgtatctaaattaatctccaaaatctaaaatttacaaggattggctagtcgcaggagctggtctttggcctatgtacttagttcaaagagtagaagagagaagaggcattgttcacaaattcatatgaggatctgccaaaaaagagaggcttcataacctacaggagaattggtattcagaaaagatggcaggttttttttctaaaagcaataaaatgttggaaggtagtatatccacatgatagaagagatagccataaaaagaacattaacaaagtgttaactaatgtgactaaaatcatgacacaaaattttacagccagtataatctcaactatatagaaaagatacaaaatattaagtctgaaaagcaccaaaatggtaaccatagtggagtagacaatgagttatttatttttctttgtttgcttttccttatttccaaagtagtctaaatgatggatatactctagctataatttttttaatgaacttaaaaaatgtaaacaaaaccactcaaaatagaaaaaagtctgtttcttaattaaaatgaaaagatttcacactgaattcctgaatgggtatctgcaacaaattaatagctatttatttttttgagctatgatagaatactttacatatatcaaccttcataatttgtccaaattactttccaaatgtaacttgtgtgaaaacacaaacatctataaatgtcagttcatctctattttctcccttaaaaaaaaagaaacttagtgcatatttatgcaaataaaggagtttacaatgagttaaggacaagtcactgtactttgattttaaaattcctgattctcaaggacacagtgtctattgatgcaggcatgatgtaggcaggatttctgtttgccagaacctcctgctttcactctccaaattgacaaaaaatgaaacgtttggtcaccttcagcaccaggccccagcaggtatccatcctcctcagctgaacagaagctcaacttcccctctccttgggtatccagtagccccgcactggccccttccctccagaacaggctgcagtgggcggggcctcgttagctgtcactctctgcagggcacggttgccaaggaaatggaatttccctcgtgatcctctgggcctgtcaccacatctcagcctaggatttttctcgtcctaagagggccaagctgacactgatggctaacaccatgtgccccccagccctttgggggtcgtactgtttgatgtatataaacagttactgtctacaaaaggctctttgttacacactgttttccctcatagttcagaatgtttattaatatttgacaatagagcaaagtggaggagaggaggcagtcacttcctggaaggaaagctggactctattttttccagtcagccttaccccacccaagaaaccttgcttctcattaaaaatacagccagacccagagaccaggcgccctgcttcaaggggcacaagtgccgaccaggcaacctcaagttgcagggagagagagaacagggaggcagaggatgccaagccttgggaactgcaggggaaaacaaaaagtcccctgcaccagcaccccaacctctttcaccagctcatttttttttcccccagcaggcctcttcccttatgggaaccaggagaaagaaaaaacagctctggttatcactgcagagtattttaattttacactgtgcgggaggatgtgacgcagtaatttggagggtattttggcccatgtaaacctgctttgaggagtctcgggcctgcggcacggaggtacaacgtacaggcaggaagggagaaaaaggagccactgatctggctgagaacaagaggaactcactgtttgtcagcatctgcaggtcttccactgagggaggagaggctttcttctcgtaaggaatgactgtgttcagatactgcaagacaaacagcatgcagggggcttgagacagaagacatgcttcctctgggttgagatttagcctttctctaagacacacactgcaaatctgaccttctctgaaacattcatggtcactggtacgtcactgtttcagaacttcttacccctctttagggaatgtctctttaaaagtaagactttcccacatttctctccatcccaacttctagattcttcctacactacaaacttctctgttatttaggaatcctggggagctttttctcctttagactgaaagcagagaataaatccaaggggattatattttcttattctttgcagtgcaatttgagaaggaattgtttgtcttttgtcaaaaaagatatgcaagagaacctcaaccccgcccagggtctctgatgtcagatttgctccctctgctggatgtcaggtgctcctacaacaaaaccagcatcagggcctagtgggctgtcaaaggagtctcaaggaagcctgaggtggtgagtgccagagctctagatcaaagctaagaagctcacttttttttttttttttgagacagagtctcgctctgtcacccaagctggagtgcagtggcttgatctcggctcactgcaacctccacctcccgggtttaagcgattctcctgcctcagcctcccaagtagctgggattacaggtgcctgccaccacacctggctagttttgtatttttagtagagatgaggtttcaccatgttggccaggctggtctcgaattcctgactttgggtgatttgcccacctcggcctcccaaagtgctgggattacaggcgtgagccaccgcgcccggccagaagctcacattttagtcttggctttgccactgacagtgtgtgtggctttggaaaaatgccttgaatctccaggccatagttctcactgccataaaacaagaggactgggatcgatgctgctaaaatctcttccccttctctagactctctagaattctagagttctagaattctagcacttagaattcagctacaaatatgtttaaaacatatacactttcatgtacactcattccaccatctcaaactttctgttcacgtgccagccatgtctattagattatacactccatgaggacaggggtcaggacttttcacctttgcacctgagggcttaacaacagagcttagcacatagcaggcgcttgataaaagttgtgaatgctgtcttaataaccagaaatgcaagctatgtcacagggaaattactgagccaacaaaaagccacagcatgggttccaaccagagctgggaagctgcagaggcagtcttagtgggaatggcttggcaggtgatccagtgtggtggaaagttaactaaactctaggatgggatctatcatcaaatggactccctcttaatgcatttcatccttaaaacaacttaattcttagacctacaagcagtgttgagttttaagtcttgcccatgtcctagaacactagagctcaaaaaaaaaaaaaaaaaaaaagtttgccttttaaaaagatattctctgttcctccttaagaggagaaaaaagtgttaggacccctaaccccctaaataaatgctgggataattctggtgagtcactgtccccctgcgttgctggggaggccaagctgcaggagtctaggaagagagcttggagcagggagactacgcgtacctgtttgtcagttcctgaggagccaaaggtctggcggatgccactctgcagaatgttggagatgccttccatgctgaagcgctgtgggggagagagactcaagaagggcaaatgcttcttgctacactgtcaccacacccagggacctctcagctaccaggctgtcccagataacgccccagggttctgtgactagacagtaagtgtaagacactggcttacagagacaggccagaattgaagcctgagctttgcaagaataaacagagtctcaagaactcttatcttagtaagtccctcagggctacaagacccctctgcatcccccagttttcctccttttatcctccatcatgcaaatagaaaaataaagcagttcagtcaaacttaaatgaaccatgatgcaaagatcttaggggaaaacaaaatgttcagctatcagaagaggctgtcttaaagcaactgtcctgatgggggaagtttttttcaaaatgtacatgcggagaactaattccataggtctgtgatagagcctagggaaaggcattttgaaaaaaactccttagataattctactgagctcccctgattaagaagcatgagtggctgggcgcagtggctcacacctgtaatcccagcactttgggaggccgaggcggggagatcacgaggtgaggagtttgagaccagcctgaccaacatggtgaaactccgtctctactaaaaatacaaaaattagccaggcgtggtggtgtgaacctgtaatcccggcgactcaggaggttgagacaggagaatcgcttgaacccgggaagcagagattgcagtgaaccgagatcgcaccactgcactccagcctgggcaacagagtgagactccatctcaccaaaaaaaaaaaaaagaaaaaaaaaatgaaccatgagaaccaggggtttgggttaaacccaaaaatagaacaatagaacaataaggcatctggggccaggcacggtggctcatgcccgtaatcccaacactttgggaggccaagatgggcaaatcacctgagatcaggagtttgagaccagcctggccaacatggtgaaaccccatctctactaaaaatacaaaaataatccaggagtggtggcatgaacctgtaatcccagctactagggaggctgagacaggagaattgcttgagcccaggaggcggaggttgcagtgagccgagatggtaccattgcactccagcctgggcaaaagagtgagactctgtctcaaaaaataataacaataataataaggcacctgatcattttcaatcactgaaacaccttagcacgccctaaagagaccagtcaggactggaacctgggacacaaggagggatttggacccagaattctgaggcccatctcaagactcccaacacgaaataccctcactccactttctttaaggtcttgcctacagagaacacaagccaaattcaattatttcctaatgtacacactgtcttcctgggttagactgtgagccctttgggggagtggaggagataggtgatatcttctccctttctgaccccctgtctgtcacagtgtgctgctcaccaccactgctcggtaaacgttgatgagtcccctgcagggttggtagggcactgaaacgggcagggttggaggttggaggcacccagtcttccacctggttgttcacctaccttgagaggcatctggtttcccttctctatccggctgctctgcaggctcagccctttctctttccgcctctttttcatcagttctcgctgctccttctgcttgttctgaacctcaataagcaccgtgataaaggagttcttcacttccttctcaaactccagctcgtcccggcgggccagctgctgcaccagctcctccgagaagtcacggatggcaccctccacctggtccagcagctcggtcagctcagacccagacatgtgcctcagccctgcaggggaagaccgtctcccgcataacacctgcatccacaccagagcccgctggggaggctcctggggccaccaccaatcaagatgggactgcccctcagaggagatcccttccaactccttaaagatccaagaaagaccttcacaatttacgagcacgccaggaaggcgggggcctgtgtactgactgcagaagagaacacccctctcaggaaacaaaggaggaagaagaaacagcccacgaggaagtctgtggactctattctcaaaaatggggatggtttgttccttctattttctatctgtgtccataagattccttgtgtgaaatgggtcaagaattggggatggaaaagtgatgggagggaggtttttgtcatccatactgaagagcaatagagacgttggtgcttattcccaagaactgatcaagatatagcatacggcaacaacaacaaaaaagccgaccatctgagcccttctttacatctctggtcctgtgtcgcagtgcatgtattcaaaaatatgtgaaacctggaagattggtgactatgcatgaaaaaataaagcctagcgggttagcatacggcagtcagctactttcaaaggaaagaaaagggaagctgagatcatgggaaatatataactttaagaagtctcctaagacttctttcatttaaaatagatttggatattttattccaaatttttctgtttacatgttatatattttcatagttgagattatacttgtatacaggtctaaatcatgctttaaaactttatacactttaggccaggagcagtggctcatgcctgtaatcccagcatattggaaggctgcgatgtgcggatcacctgaggtcaggagttcgaaaacagcctggccagcatagtgaaaccctgcctctacttaaaatacaaaattagccaggcatggtggtgcctgactataattccagctattcggcagagtgaggcaggagaaccgcttgaacctgagaggcggaggttgcagtgagcagagatcacaccactgtactctagcctgggcaacaacaagagcaaaactctatcttaaaataaaaataaataaataaataaataaataaaaactttataccctttaagcattttctgattaaaaattcttttaaacacttaaaaaaaaatttaggccaggtgcagtggctcacacctgtaatcccagcactttgagaggctgaggtgggtgggtcacctgaggccaggagttcgagaccagcctggccaacatggtgaaactgtttctactttaaaaaaaaaaaaaaaaaaaaaaaaaaatatatatatatatatatatatgtatatatacacatatatatgtatatatacacatatatgtgtatatatgtatatatatacacatatatataatttgaaaaaataaaatatacttgggaaacatcttttaaaatgtgtctccatctaatggtatctttttgcggcaggggaggaagaattaattgattgactggtttttaatttttaatttttgtgggtacatagggggtgtatgtgtttatggagcacatgagatgtttggatgcagacatgcaatgcataataatcacatcatggagaatgaggtatccactccctaaggcatttttcctttatgtcacaaacaatccaattatactcttttagttattttcaaatgtacagcgtctaatggtgtccttcactttcacctcagaatccatttccctcttcctctttgtttctgctttgcccggatatttgctgacttggttgggctttccccttattctgctctttggagctgccctctcccccttctgtttttttgccatttcactctgcatttcagctgttttcacaagtcttttgctgaacgcgtctatctttgggacctttgtgtggctgggaagggcctgacaagggcagtcgggaatgcagcgaggcagccaagtccagttcagcaccgagcagactctctgccggccacctcctgccgctgctattcaaagccaaagtctgacttgcaggatgcaggcctccagattctgcctctgctttcaccacttctaacccgcagttgacctttgaaccctgaccaacccaccttctccctcccctgtttctaagttcccatctccccatgggtggatcaactcctaggatggggccccttctgcagcgtgggcatttgataccctacggctggtgaattgttctgcctttgctgtgttacactttttcatttcatgcttcatccagccgtttcttgtgcacagtcataattactataaacctgtgtcagagagttaagaggatggcctctggagttaacctacctggcttcaaatgttagcttcaccccttatggcttctgcatggactaagcacaaatacaaattttaaatgagaggcttgattctccccgttgaaaataagggaagagacttttcctctcccccacctcccttttctttcagaatttcttctacctatccttttcaatctctcaaagatttagattaaatctttaaaataaacatatgttacatttacattaaattattgtcatggctaaaataagcctcttgtcattcttataattcaggaggctttcttcaagggcctggaggttactgctttgaaatataatcatcgggccgggcgcagtgggtcatgcctgtaatcccagcactttgggaggccgaggcagtcggatcacgaggtcaagagttcgagaccaccttggccaacatgtgaaacctcatctctactaagaatataaaaattagccaggcgtagtggtgcatgcctgtaatcccagctactcgggaggatgaggcaggagaactgcttgaacctgggaggcggaggttgcagtgagcagagatcatgccactgcactccagcctgggcaacagagcaagactctgtctcaaaaaaaagaaggaaagaaagaaaagaaaaagaaacataatcatctctcattgttctgagcagaggggcctaactcccttccgactccaaattgcaaaacctactcaatgtaatgggttccattcatccacttagctacacaagagtgagactgctttctgtctttgcagtctcttcagagagttgtctgtgatgtggctcccatcctggtttagtgcttattcaataataaaatagttttctaggccgggcatggtggctcacacctgtaatcccagcactttgggagaccgaggcaggcggataacctgaggtcaggagtttgagaacagcctggccaacgtggagaaaccccatctctactaaaaacacaaaaagtagctgggcatggtgatgcatgcctgtaatcccggctactcagggggctgaggcaggagaatcgcgtgaagctgggaggcagaggctgcagtgagccaagatcatgccactgcactctagcctgggcgacagagcgagattctatctctaaaaaataaataaataaataaaaatagtaacaaaatagttttctttctcacctgtctttgtggagaggttttctgaacaggaaggaaatctcatttctaatcatatttccctaacagtggccttggacaagtcatgtaacctctgaaagactcggttagcttgatccaaatggggttggtgtgaagatgaaatgagattaggcataggaagtcttagaataaggccaggcgcagtggctcacacttgtaatcccagcactttgggaggctgaggcaggcagatcacttgaggccaggagtttgagaccagccttgccaacatggcgaaacctcgtctctacaaaaatacacaaattagcagggcgtggtggcacgtgcctgtagtcccaactactcaggaggctgaggcttgagaatcacttcaacctgggaggtggaggttgcagtgagctaagaccatgccgctacactccagcctgggtgacagacagagagagactctgtctcaaaaaaaaaagaaagaaagtcttagaataaggtctggcacatagaaagcacttcagaaatatgagctgttactattaccttttttattcattgattttatggtagcatcattcattgcttttatatagtagttcagatttcttctgcttattctgccttagtcttgttctttggttagttttaacatttaaattttgctcgactaccttgttcttttctcaaaaatgcaaacttctctcctgatgccgagtaagaaaggtattgctgaccacctagatctgcaaggctctgctctgaggcagtcagggttctattagccatgtacaaagcacacagcccagagcctggccccgagcaggtgcttcctcctcggccagcccagcgcccagggccctcaccttcataggaccagttgttgttgaaggtctgtgtcaatgcctgcatctcctgcaggaggaccgagtctgcctgggaggaagtttctcctccatcctcttcttccagaacctcctcttcttcctcagggtctggggagttctgcatcatttcctcaatctcctcaattacctgaagaaggtacacgagagagtgctaactctgttctctgctagaggggcattctggcttgaattttgatcagttaaggatgttcctaattagctatctgaaaatttctaaagcaatattgtttttacataaatactgaataataaaaatagttccaaccaaaggcttgcatacactctttctttaatgtaaggcactctttaatgtaaaacctcttccaagagctccttttagataaatgacttattggaaataagctgctctttcaggaagcaaggcagagctgcctggaagggaacatttacttcaatgtgctgagctatttctaagtgggaaaatatttcattcacccaactttaacacaaaacccagtccattaattgacataatacacgtgactgtaaaaaatagcgtgctcctagaacaacacaaaatggggaggaaaacaactatttctccagaattcacctagacaggaactgaagctgcccagcaacaaatgaaaatagagataatgaaataatagaaggataggtggagtctagagagcagcaaatagataagaaccccagctctaatctagactattgacaggagccagctcccagaagtggagggaaaattagatatctgccaaaaggaacaaaagtgaattactagctgggcatggtgtctcatgcctgtaatcccagcactttgggaagccgaggcaggtggatcacttgagctcaggagttcaagaccagcctgagcaacatggcgaaaccccatctctgcaaaaagcagaaaaattagccagttgtggtgacgtgtgtctgtagtccatgttacttgggaggttgaggtgggaggatggcttgagcccaagaggtagaggttgcagtgaaccgagactgggccactggactccagcctgggcaatagagccagatcctgtttcaacaacaacaacaaaaaaaagagtgacttactttgtacattaattatttacaaataaagaagactgctgctgaaagcaggtctttagatgagttttgtcccaaccttcacctttgtctgttctccatggatggactaaagtccccgaggccagcattgtactctttgaggtggtttcttcacagtgggctggaccaaaggtaaggggtttcagggtctcctcctttagaataatttccattcttattcccaaaccttttcacctctactcacaaacttaggaaatacccagtctttgactactgaaagccattttacagaatgcaaccaaatgacacaagtccctgtcagggtcttatggctgaatgtccttttctctaagaggagttataattgagttcatatcattgaattgtagatcctcctacaagtcacaagaatagctattagcccctatttttaaaaatctggttctcttcagtctcctaatcctcacgtgtttcaattcccacctttctatcacagatatgaaaaagcaccattgctgctaaaaaagcactttctggcaccgaaggctgccagtggagctttgcagaaagactttgtggaaacttatgtagtgtttagctcaaaataagcacccataaatatttgttgactaaaacattaaataaggaatccagaaactgaacattatcctctctaagtaataaattattaaagctatgatgatctcaattgaatgcgaagcactctatcttttttcacaaagtcgaagtggctctaagactcctttcggaaggcccaaaattttgagtgttctatgaaatgtaagaaaatatccatcacacaaaagcctcatctgtcacttctctttttgggaaaacaggtatttgggacccttgtttgagtgtcttgactccgagtacaacgaatttcaataagaaggcttagcaggattgtagctactaaacactatgcctgtctctggctcctatcagagactgaccccaactatcccaagtgtcaagaatgacattcatgttcactgcaggtgggcaacctgaggcagaaagagagatgaaatcccttatcaaaaatactctgagttggacagtcaccgtggctcatgcctgtaatcccagcactttgggaggccaaggcgggtggactgcttgagtccaggagtttgagaccagcctgggcagcatggtgaaacctcatctccactaaaagtacagaaaattagctgggcatagtgatgcatgcctgtagtcccagctacttaggggcctgaggcgggaggatcgcttgagccaaggaggttgaggctatagtgaaccctgattttgccactgcactctggcctgggtgacaaagtgagaccctgtctcaaaatgaaaaaaaaaaaaggtcaggcacagtggctcatgcctataatcccagcactttgggaggttgaggtgggcagatcacttgaggttaggagtttgagaccagcctggccaacatggtgaaatcacatctctaccaaaaaattttttataagaattagccaggcatggtggtgcatgcctgtagtcccagctactcgggaggctgaggcaggaaagtcacttgaatccgggaggcagaggttgcaatgagccaagatcacgccactgcactccagcctgggcaacagagcaagactctgtctcaaaagtatatatatataaagaaaaaaaagaaacaaaaaatactctgagtcatgagcacaggcaccacatgaccacatatctttcttctgccttaaatggatgtggcaagtgtgttctcttggactttttctccatcaaaagaacaaaaggtcccgataacctggagagatacttatacctgatctgctgtgagcagaggctcctcgttgataccggaatcattttcactcttctcattgaactcttcctcttctttctcatggatctggagaggaggtggggagatggaattctgggtgaccatcagcagaagtgggattgcctctagtctcgagaatggatgatactgactgggaggccactccagccagctgctgtctaaacagtggagctgaagaggtgtccagagtttcatccaattccaaacatatctttgccccatcactaactccagcatgccagaaatccagcatgcagcactgaatccaacttggcaggaaaagacgacaggggaatggccagcaccattctgactcaaaggggacagcaccgttttttaacccacagacaggtcatcctggggtgaacaaggcgccttctccaggtaagtgacactgcagccaactgcagcaaaggtgccctgattttgttaaggagttccaacctggggggttgtttccagatttcgtcttactaggcattttaaggaataggttgttctagtccaaataatgatgactttcagaatttgatgaaatgccatcctgttactggaatccaggcatgatgtcatagctgatggcagatgtaagaaatctgcatgggacatgccactgaataacctgaccacatgaactaaacaacaacaaaactacaaaagagaaccccatttatctcatttgccctgtgtctctataattccataatcccaagtaagatcctcaaagttcacagccatcaaaattctagatgtttaaatctaacaagctattcaaagcatatctggcttaactgaccatatcccaaactgccatagtctggcatttacattcaagtcccacagaaaagttaatcactaaacacctaacaagctgtatgtctagaagtctgatttgaacgtcatacaaggaggaggcaggaggtgtctctaggaaatctctctgctgagtcacctctcatccaggaatgaatcctccttgcgctccagtagctggcacaccgattggccccttccctggggcttgtattctgccttttctaacaggaaacagcccagctccaatccaagcaataatgtcagaggtagtctatcctcagaaacttctcccgtcttctgtgagctttgccttggcagacatccctaacagagcacatcaccttttatctccatttgcttaaaaccaggactatgtcattaaaaaagaaaaaaaaaattaagcaaatatatctcaaatgccatccgcactcaacctagatatggggtaggacagggaggtaatggaatcatctgaagggcccgggtaccagatggtgacatctatttccgctgtcaaacccatatgctcctctctctgccaagtccaccacctgcgatagcctcgtggtttccaccgctccccactatgcagaacaaaactcctggagctacgctttgttcacaactacactcatatggaagaactttcttcaggccagaaaatcctgcagtagaagttagcccaaaattaagagaacgaagatacattttttcctccagacaaaaattaggggagaaaaaggaagaaatgtatcaatatgaacccagcccaagttagtgtgagcccaagttaggctcatcctgggaaacagggttatttttcataagcatctaacagcaactgttagtctataaccaggatttggcagggggtagggggtggtgggcactaagtctatataaaaatggcatgtttaccttttctgaaatgtggctgattgtagtgggtttaactccctgactgttaatattgcttctttcaactatatcatctcctccctccccaagttcctcactccttggggagttccaggaagaaggcagggaggaagcttctagggatagatccttcttgctgctcaaatgctaataagcctgggctgtggccggaatgatgcactagtagagtttctctcccctccccctctcaggcgcaaagcctccaggtctgaattgtcaggcttgggaaaacagagatgggaaaatcaattataagcttatgaaaggtactgtgagttcctactcttatgggaaccatactcatcccttattttcttatttctcagaagtctgccactaaaaaataaaataaaaggagaggcagacataaaatacggccaagaaaaccctggctccttccctctatgtgcgggttaccccctaatccttgggcttccccacctccatcgtgccccagcctcttcacctccctctccagcgtttgattctgatcctctcacccttcccaccctccctaggcctggttcccacattttctgtccatcctgccagactttgctctgttccaacagcatccatcacttcacaagcccttgcctctttacgggcactgtttacagactccttccctcccctccttgaccaggacagtatcttgtgcacagggtggagagctggaggggaaacaatgacagaggaagaaagaaaggtttttgaaaaatgacagcccttgtgcatataaatactcttaatcctagcataagacactgacatagatatcacggtagagagttcctttagccccttgtgcagcagtggggaagatacatgtcaaaaataacttcaggccaggtcatttagggctgaatttctttgtcagctaaaactgctagttgttaccagatgtggtggcttacacctgtaatcccagcactttgggaggccgagatgagaggattgcttgagtccaggagttcgagaccaacctgggcaacatggcaagactccgtctctaaaaaaatagaaaaattagtcaggcatgatggcacacctgtagtcccaactactcaggaggctgaggtgggaggatcaattgagccatggagatggaggctgcagtgaggctgcagtgagccgtgattatgccactgcactccagcctggatgacaaagtgagatcctgtctaaaaaaaaaaacaccttgctagctgtttggatactattgacgtgaactatgcttttccaagaaaagtcattcttccaaatgatttattcccagaattgagaagatttgaatccagaaaggggtctggctataccattcagcaagctgtttcttcctcctgcttttgggaagagtgtgtctctaggactataacatgaaagcttgaaacttgaaaagaaatgcagaaaactttccccaaggcctataacattgctaaatcttgctgcacagtgaagtattctgaatgatgattaaaattatgtggagcccttgattccaataatgactattaaccagtgtattttattaaagtgtttcaaatgaccccattcatagaaaaggtaatttttacagcatatttagccctttgcataatattttcctccccttaccactattgtttgacatgagtggttgcccccctgacaaaaattaagagaacaaagatacatttttaccttcagacaaaaagtaaaaaaaaaaaaagaaattcacaacaactgtgtcccattttttttttttttagacacaggatctcgctgtgtcacacaagctggaatgcagtggcacaatcatggctcaatgcagcctctaactcctttgctcgagtgatcctcctgcctcagcctcccaagtagctgggactacaggcaggtgccaccacacctgactaagattttttttgttttgaatttttttagagataggggtctcactgtgttgcccaggctggtctcaaactcctggcctcaagcaatcctcccacctcagcctcccgagtgggattacaggtgtgagccactgtgcctggtaactatgtcccttttatgcttatgaacaaccaggaaacatctgcgtggattaagtcaatggctgtgcattcccatagggagatgcactagggcatgcagccaacacatatttgttgaaagaattaatgaacaattgaaaaagagaggactgagagcagtactatcatctagattcagtccacttccacaggtaacttagctatttagtcacctggaaaagaggaagatgtgactgggcatggtgtctcatgcctgtaattccagcaatttgggaggccagggtgggagggtcacttgagcccagcctgggcaacatagtgaaactctgtctctacaaaaaaaatgaacaaaattagccaggcatggtggtgcacacctgtagtcccagctactcaggagatggaggtgggaggattgcttgagccagggaggtggaggctgtagtgagccatgactgttgccactgtactctagcctgggtgacatagtgagatcctgtctcaaaaatatgaaagacataattcactatcctggacttccaatttcctcttatccagacaaccactatctgctattaaataaaggttataaggtaaaaggagactgtgttttacatcacaggaatagaatagattgatgaatcgaaagccccagtaaaagtggtaaattgtgaaaaaaataataatgcctcctacagacatattaactcaagcaaattattttgacctaaaaatgtaaatgtacatttatttattcaccaagttcctagtgtaggaccaagcttacaatgaaactctgagtagagttccacagtctctcttgcatcatccacataataacttttttttttctttttttaaacagagtctcacaatatcacccaggctggagtccaatgacatgatcaaagtccactgcagcctccctttcctgggatcaggcaattcttccacctcagcctcccaagtagctaggaacataggtgcacaccaccactcatggcaaactttttcatttttttgtaaagattgagtccaatactccctctttatctttacccaggctggcttctaactcctaggctcaagtgatcttcctacttcagcctcccaaagtgctgtgcttacaggtgtgagccaccacacccagcccataacataatttttaaaatgatttcctgtttccatttctttatagtagaaggtgggtacacaggagattgggcacaaatttatcagcccttcctcctcaaaccctactaaaatgagagtcaagggatcaaaaaagaataacccaaaagggacaaagtgaacaggagaaaaggcaacagcaagagaaatgccagaaaacagacgccggcccagcaggctcagcagggttaaacttggcgagagcaggctgcccaaggtaaagggggtcacacagcagatactgaatggctcaggaattgcagaccccgaggggcagcatggcggggctatgtaaggaagatttgctggtattcttcatcaagaataatgagacccaagtgtcttcttccaacccagataaaaagggactgcatcctctcagctcaaaaggactgtagacttcactctgagcaggttgaactggaggttctggactcagagcaccaggccacctaaaagtgagggtgagggttctcaccaaaaacagagagaggatgtaagactctacagaatgactcaccagacagacctctggcctccttccctgagtaggctccaaggacactggcagctggtttattctgtccatcaagccattggagaacacctctctatggatgctataagtctacaaatacatgccaactgtcaagatctccgaacaagacgcataggtccttactggcactgtgatccagcaggaaacaagccctgaccccatagccttctagggcctcactttctttttttccaagggtttccctctgtcacctagactgaaggggagtggcttgatctcagctcactgcaacctctgcctccccggctcaagcaatcctcccacctcagcctcctgagtagttgggactactggcgcatgccaccatgcccaactaacttttgtattttttgtagagatggggaacttgccatgtttcctaggctggtctcaaactcctgagcacaagcaattcacctgcctcggcctcctaaagtgttgagattacaggcgtgagctatcaccagccattttttttaaaattaatgtttttagagacaggggcttgctctgttgcccaggctggtgtgaaatggtgtaatcatagctcactgtagcctcaaactcctaagctcaagcgattctctagcctcagcctcccaagtagctgggactacaggtgcatgccaccaggcccagctaatgcttttttttttttttttaattttttgtagagacagggtcttactgtgttggccaggctggtattgaaaattctgggctcaagtgatcctcctgccttggcctcccaagtagttgggactgcaagtgcactccatcccctggctacctttttgttttttttgtttttgttttttggtagagttgtagagatggggctggtcacaaactcctaggatcaagggatccccctgccttgtcctcccaaagtgctaggattataggagtaaaccaccatgcctggccataaagcctcacttttaaatatgaaaagatgctcaaggattgccagacatttgagaatagcccccaacatgaaagatgaaaatgtatagagaagagaaatcaaaagcaacagagagagcagaagaaacctcttctaagaaactgctatacctgccttcagaaggataacagaacaccttgcttcctcaaaatgtgtcctatttatcagaattcatttaaaaactacaaagatgtacacttactaagaccagaaaaaaattttaaaaacacacaaattctgtaaaaactggaaagggctcttagaaattaaaggtatgatagaaaatttagacttttccatcgagctgaaggctgagaaagttccctggagagtgaaacaaaataagcagatagaattatgggcggggaaaaatattcagaagatcagcttcagaagtccaatacttgaataaaaggaattctagaaagcaaaaacagaagagatggcccctttcagccatgacagagtaactggtattggacttatccctcctaccataaacaactacaatctggacaaaatctatgagccaattgttttcaggcactggacacaggcagtgcaaggctgtgtgttttgaaagaagggaaaaacatgaaataaatgagataaataaatgaaggctaaaggaatctgtcacctgtggctctacaccaaaagaaatgctataaaaagcattttgggttgaaaggaaatgatagaaaatcagaatcttcaggaaaaaataaggaatgccagaaatgataaatacataggtaaatattttaaaagtatcttttttttccttcttttgattttcttaaaagacaactaactgtctaaagcaaaaataataactttgtgttgtggagtatataatgtagattgaaataaaatatatgacaattatagcacaaaagatggaaggaatagactttatactgtgacaaatgttttacattttatgtaaagtgtacaatattaattctaaatggactatgattaattaataatgtatagtgtaacccctagagaaaccactaaagaaaaatacgacaaggtatagataaaaatccaacagaagacataagatgcaaagccaaagaatatttgattaacccaaaagaagacaaaaagtgtggaacagaggaacaacaaaacagcaacaaaaccagatgggacaatcagaaatgaagacaatacgctccaacacaaattatcaatattatgccaaatgtcaatggactacacactatgcaaataaactaaacacaataatcaagaagcataaattgtcagactgaatataaaaacaagatccaagtatacactacctgcaaaaacacactttaaataaaaagacagagataggcagaaactaaaaggattgagatagatacacacacacacacacacacacacacacacactttgcaaacagtatgcataagaaagcttaagtggctacattcatatcaaacaaagtagattttaagataagcattacagagaaagaatgacatttcataatgataaaagggtcaactcatcagggagatgtactcagagcttcaaaatatataaaacaaaaatcaacagaactaaagaaatagaaataaatgcacaacaatggttggagattttaataaacctttctcattaattgatagaataaacagacaaaaaatatcatttggaacacaggaattcaacaatactatcaaccaagttaacctggttgacatttatagcacattacaaccaacaattgcagaatgtgcatcatttccaatggcatatattacattcactaagacgtaccatatgctggaccctaaatcagtctgaacgtattttaaaagatttaagtcatacaaagtatgttctctgacaaaattaaattagaaatcaatttttaacaagatagctataaaacctcccaagcactttgaaattcagcagcaaactgccaaataacctatgggttaaagaagaaattgcaagaaaaaattagaaactatgtttttaattgaatgatgaaaacatacccaatcaaaatatgtagaattcagctaaaacagtgcttaaagggaattttatagctttaagtttttttaagtttaaaatataatcaaatttcctaccttaagaagctaaaaaaatgagggcaaattaaactcctactaagtagaaggaaggaagtaataaagctaagagagggaatcaataaactaaaaagttaacaaacaataaaggaaatcaaagaaataaaaagtggttctctgaaaagattaataaaggtgataatcccacagaccagctgacaagagagagtgagagagggatggagggagagagaacacaaattaacaatgtcaggaatagaaaagggaacatcactataaatcttacagacattttcaataacaaaacaaaattataaacaaatgaatgttcaatacattcaatgattaaatagataaattccttgagaaatgtaacttatcaaacctgactcagtaaaattgaatttgtaactgaaaatcttccacagagaaaaccctaggcccagatgctttcactagtatagtctatcaaacattcagggaagaaataataccaatgtaatacaaattctttcacaaagtagagatagagaggataatttccaacttattttatgacattagaacaaaataaaatttcagaaaaagaacatgatgcaaaaatctttaataaaatatcggcaaatcaaatcccacattatataaaaaagataaaatatcataactaagtggggtttattttaaaataaaatgctggtttaatatttgaaaaccaattaatgtaattcatcacattaacatgataaattgatctacatatataaattggtctgtagattctacacaatcaaagtcaaatttccagcaagattttttgcaaaaattcatctgctgattccaagatttatatggaaatgtaaataacctaaaataactaaaacaaatttggaaagaaaaaaaaaggacacagttggagaacttatattactttatttcaagacttaccataaagctacagcaatcaatacagtgtgggattggcataaagatagacacattttaaaataaattagggatgataaaaaaagacacacacatatatatatcattgaaacagaaaaaagaattcagaagtagatccgcacatacatgatcaattgattttcaacaaagatgccaaaacaatttaatggggaaggaataagattttcaatgaatggtactggaataattgaatagccatatgcagaaaaataaaccttgaagcccagcactgtggagtgcctcggtagtcccagcaattggggaggctgaagcaggtggatggcttgagccaaggagctcaagaccaacctgggaaacagcaacctgggaatcaaaaattttaaaaaatgagccctgacccttactccatactatatacaaaactaatttgaaggctgggcacagtggctcatacctgtaatcccagcactttgggaggccaagacgggtggatcacttgaggtcaggagttcaagaccagtctggccaaaatagtagaactctgcctctactaaaaatacaaaaattagctgggcatggttgcaggcacctgtaatcccagctactcaggaggcacagacagaagaattgcttgaacctgggaggtggaggctgcagtgagccaatattgagtcactgcactccagcctgggcaacagagcaagactccatttcaaaaaaaaaaaaaaaaacagaaagaaactgatttgagatggatcatagacctaaatacaagagctaaaattataaaacttctagaagaaaacttaagaaaaaaatcttagtgaccttgggtttaacaaagatttcttaaatacaacataaacacaaagtataaaaaggaaaatatcaataaattggacctcatcacatttaattttccttttctttttttttttgagatggagtctcactctgttgcccagactggagtgcaatggtgcaatctcaacccactgcaacctctgcctcccgggttcaagcaattctcttgcttcagcctcctgagtagctgggattacaggcacgtgccaccatgccaggctaattttttttttttttttttttgtatttttagtagagacagggtttcaccgtgttagccagcatggtctcaatctgctgacctcgtgatccacccaccttggcctcccaaagtgctgggattacagacatgagctaccacgcccggcctaatttttctttttgagaggggatctcactatgttgcccagtctggtctttaactcctggcctcaagcaatctgcccaccttagtctcccaaaatgctgggattacaagcttgagccaccacactcagccttcatcacatttaaaaaacatttgctcttcaaaagataatgttaagaaaattaaaaggcaacctatagactaggagaaaatatttgtaaaacatacattcaacaaataatttttatctagaatttataagaaactcttatggccaagcacggtggctcatgcctgtaatcccagcactttgggaggccaaggcaggcggatcacaaggtcaggagttcgagactagcctgaccaacatggtgaaaccccgtctctactaaaaatacaaaaattagccagtcatggtggtgtgcatctgtaatcccagctactcagaaggctaaggcaggagaatcacttgaacctgggaggcagaggttgcagtgagctgagattgcaccactgcactccagcctgggtgacagagcaagactccaactcaaagaaaaaaagaaactcttacaactcaatactaagaacacaaacaatgtactaaaaaaatgcacaaaagatttgaagaggcatttcaccaaagaaaacatacaggccgggcacagtcacgcctgtaatcccagcactttgggaggccggggcaggtggatcacttgagctcaggaattcaagaccatcctaggcaacatggtgaaatctcatctcttctaaaaatacaaaaattagctgggtgtggaggtgtgcacctatggtcccagctacttggggagctgaggtgtgaagattgcttgagtccgggaggtggaggttgctgtgagctgagattgagccactgccctccagactgggcaacacagcaagaccctgtctcaaaaatacacacacacacacacacacacacacacacacacacattgtaaataatcacttgaaaagatgctcaatattctatgtcactagagaaaagcaaattagaactgaaataaggtatcaattttgttactacccatgaagatgtctaaattttaaagattgtccataacaagtgttagtgagaatatgggacaattacagctctcaaactgggcaacagtttggtagttccttaaaaatttagacatgggagttaaatgatgagaacaaatggacacacggaagggaacaatacacactgggccctactggaggatgaagggtgggaggagggagaggatcaggaaaaataaccaatgtatactaggtttaatacctgggtgatgaaataatctgtacaacaaacccccatgacacaatttacctatgtaacaaacctgcacatgtacccctgaacttaaaataaaagctaaaaaaaaaaagttgaacatacacctaccatatgactcagccattccacacataggtttttatctaagagaaatggaagcatatgttcacacaaagacctacagaaaaatgttcacagcagcttcatttgaaatatgcaaaaagtagaaaaaaaactgttcatctataagcgaatgaataagccgctggtgatatatccatacaacagaatactactcaacaataaaaagaaatgaactgttgctatacttaaaaacatggatgaatacctaattacattgagtttaataagccagacaaaagaaaatgtacatattgcatgattccattcatgcaaaattctagaaaatgaaaactaatctacaacgacagaaagcagataagtggttgcccagagattgggcggtgagagagagggatgaggaatatgttgaatatcttgattgtggtgatggtttcgcagatatatgcagatgtcaaaatttaccgcattgctcactttaatatgtgcagctcattatatgccaattacctttcaattacgatatggggggaaaaacagaataaaataaaatgataatatatcatgatgaagttgtgtgtatctcaagaatgcatggttgagttgacatttgcaaattaatttatgaaattcatcacattaacatcataaaggagaaaagctatataatcatctccacagaggcagtaaatagaaataataaatcttcagaaaaaataataagaaaacgtcacaatttgaagtcatgagcttctatgttgaaaggactcactgaggacaacataatgaaggaaaaaattcattctaaagcacattattgtaaaatttcaaatgagaaaggaaaagaacatcctaaaagcttccagaaagaaccaaaaaagtcatataataaaggagcaggaatctaaagatggagaacagagtcagcctaaaaagaaggactgggaatcggaacagatttggggtttctcaacacgacctaatgctagaagagaacaaagccctcagaatgctaaataataatattcttatatatcctaaaaaccatttcctctgtactcctttctcaaaaatatgctgaatagtttggtttgttgttggtttttttcaccaaaacaaggaactatatctagaaagatttttaaaatatggtaaccagaagacaggagtggaagacaaaagaatccccagcatgaagggaaggacgttctcaggacagcagctgtgcagctgatctagcgaatgaccagaccagtttgtagcagaaagatgaaaggtactaactgggatgttttcaagaaaaaaacatggaattgacacaatatagtatctgatttatttaagcattgtgttatttatactttttaattttctgaaaattatgatttttaacattttaaagatctttctggtggggatagactgtaccttcaagattagccaattctggctgggtacagtgcctcacacctgtaatcccagcactttgggaggccaaggcaggcggctcacttgagatcagaagttcaagactagcctggccaatatgcaaaaccctgtttctaccaaaaatacaaaaaaaaaaaaaaaattagctgagcgtcatggtgcattcctgtaattccagctacctgggagggtggggcaggagaattgcttgaacctgggaggtggatgttgcagtgagccgagatcgtgccactgcactccagcctgagtgacagagtgtgactccatcacacacacacacaaaaaattagccaattcttagagatagcaaagggctcagcaagccttctatatgcaaactaaccaaagccaagccctgccgcctctacctgacctttacatcccaggaggcagagtcctcttccttagtcatcccagagtcaggtactaggcactaaggaccatccctagtgtttacagcttgcagaaattactcaaactagccagtcctaaactgtttaccccatctcgccattcctgaggcactggcctggctctcccctggctccttctgcctccaggggacactggagcttccccatgtggccccgcatggccccactataaaagtggagctttatgcaaaaaaaaaaaaaggcagctaaaagaaatgcaagcagttgcctgtatggagtagggaaagacaagaaggcaggggtctactgttttgggtggttgttttgtcttgcacttacagtgcattactttcaaagcattaattaactttttaaactatgtagacgtgttactttgattttaacaaaaaatgacactctttgcagtcacaattcaatagttggtacaatatttaattaaatttcttagtgcagtcacaaggacagcacaaacaggtttggggacaactgattcttaaaaatggaccacttggccaggtgtggcggctcacacctataatcccagcactttgggaggccaaggcgggtggatcacctgaggttgggagttcaagaccagcctgggcaacatagtgaaaccccatctctacaaaaatacaaaaattagctgagcatgatggcacatgcctgtaatcccagctactcaggaaactgaggcaggagaattgcttgaacctgggaggcggaggttgcagtgagccaagatcgcgccattgcactccagcctgggcaacagagagagacaccatctcaaaaaataaaaaaaattgttttaaatggaccacttaagtggaggtatgagtgctcactagagagaagcatcacagctgtgcacattcagcatgccaaacgcttttggtcgtatgttttacagaaggaatacagagcactggttaatctggtaaatcgtttaaacttagggcagttaatagagctcctactgtaattaatccagataataaaagaggatgaaataaaacagccttaatccatctacttttgctaccctgtccttttcccatgggttagatagaagaaatactacaaggaacagagctcaagatcatccttctcagggtcattcagtttgccctgaaatattaaccctcttgagggaaatctggaaatgaggataaattaaagcccttttgaagggcaggctatcttatatatcctttggcttaattcacaaaatgagttggaaaggtgtcaaaagagataacaaagcaaaatctgccttttgtaccatgacggacctgatttaatttcagtaactagatttattccattattgcctccatcttctttgcggtttgggtaagtactaagcatcatacctgtaagcattacaagagaacatgcacagccgagagttcaaaacaggacctgagacacagcctcctatgtctgtgctgaggaggcttgcaggaaatcttagtctcaaagtcatcatctcacttgctcccgtcaatgaagccttgaggttttgagtaccttagattgctaattactagaaaaatggagaaggatatatatggctacattttcaacaaatcagtcaactgctgatctctttgctgtgctattttgagcaataatctacaaatatattgccgagtaaggggaatctgtttcttgctcttttacttggactcaattctgaaacacttagaaagattagacccatccaactctatcacttgctgagcctgcagggctgtgacagcccttcctgacgataaattgtcaaatttccttcacaactgaaactagaaaaccaagtgaggcagaaatttgcttttaacatagagccattaaatgattttatcttttgctgtgctctgaatgtttatgtcccaccccccaaatttatatgctaaaatcctaatgcccaaagtgatggtattagacagtgagaccttgtggaggtgatgatatcatggaggtgggatgcccacaagtatctttctaaaagaggcccaagggagcactttagacccttctaccatgtggggacacagtgagaaggtgccgtctgtgaaccagaaagcaggtcctcaccagatattgaatctgccagtgccttgatcttggacttccctgccaccagagctgtgaaaatcaacttctgttgttaataaattacttagtctaacgtatcctgttacagcagcccaaactgactaagaaaccattccatatgtagattcagataggaggggcaatttggatcttctgaaaggtcaccccctttatggcctttgcaaatcaactcaaaataaatatcatctttatttttcagaagcccctaagctactttctcccttggagtcagtaactcatggagtgtgactctggtccagacacataaacgtccccttggttgagtttcataaacaattctaggccagcatggtggctcacacctgtaatcccaacactttgagagtccgagttgggtggattgcttgagctcaggagtttgaaaccagccttggtaacatggcaaaatcccatctctacaaaaaatacaaaaattagccgggcatggtggcgtatgcctgtagtcccagctactcggggagggggtggtgggtaaggctggaggatcacttgagcccaggaggtcaaggctgtagtgagccgagactgtgccactgcactccagcctaggcgacacagtgagaccctgtctgagaaaaaaagagagacttcttccccactgtgtggctacattgctaatatctgggccccacctctggccattgtcaagtgcaagatccgtcagcacttgttctcagcactgtttttgtgggcctgaactattcatttaagatgggaaaatctaatttttttaaaccatcattatttgaacccaagagaagcccatgacagtttcctcctcttatttccggcctgaactgttcatttaagatgagaaaacctgatttttttaaaccaccattatttgaacccaagagaagccatgacagtttcctcctcttatttcaggccactttatttttcatgttgtagtacacaggttagaaatattgatagtaatggcaggctgggtgtggtggctcacgcctgtaatcccagcactttggaaggccaaggcgggcggatcacggggtcaggagatcaagaccatcctggctaacacagtgaaaccacatctctactaaaaatacaaaaaattagccaggcatagtggcatgcacctgtagtcccagctactcgggatgctgaggcaggagactcccttgaacccgggaggcgaaggttgcagtgagccgagatcgtgccactgcactccagcctgggcaacagagcgagattccatctcaaaaaaagaaaaaaaaaaaaaggaaagtaatggcagaaaaaaaattacttttgcaccaacctaatagaagtgatctgtgtttctgcttttctatagatgaccattcctatcatttcagatatactggatgtcttccttatttttcaccctcctctacaactcctccttcccaacaataattttttttttaattgaacctcctaggctcaagcaatcctcccacctcagtctcctgagtagctgggaccacaagcatgcgccaccatgcctggctaattttttgtatttttggtagaaatgggggtttcaccacgtggcccaggctggtcttaaattactgaactcaagcaatcacccacctcggtctcccaaagctgagattacaggcatgagcctccatcaacaattttgaggaagactgttgagttactgaatgtttttctaactggattccacatctcaagccctgctaaaccaggggccccggagaggtacctcagtgtcagagcagttgccattcagagcctcgatgtttggatccctccagtcttctgagagtgaagggatgtaattgtctgtcagagcatcccaaaccctgtaaacaaagagaagctctcattaacacacatctgtggcctggccccgcctggaggaaggaagagctgggccgggagaggagagaggcttctgtgtgtgccaggctgagatcatctgccttccagcatgcaggggcaaagcagcttaaaaactgaatcagaggcacatccaggggagaaagtgcatggagcttggccaggggcttcagtgtgaaaggtgtttgcttgagggaagaggaatttcctaccattgagatacaaatggcagcatctataatcaaactgcctctggctctgaaaataaatctgcccctcatccaaatagctcatgtttctgaatctaagagatgcccatgtttcttttcctatgggcagagagagagagagagaaagagagagagagagaaagggagagagagagagaggaacacagagaaagagagatctgggcagtttttctggctgaatctcattaagatcagaatcattatctagtttataaccgtttcagtttcagaggcctacaatctaaatgatcaggaattccctccttgacatctaatgtaggtaagggaataatgccaatacagtgagtgcttacttactacccaaaatgttctatcgaacccacgggttgcaagatcctgccctctaacaatgtagaatctaaatcctgcattgtgtcattccaacatcacggacactctcaggtaaatactgtatataaaagaaaccaataaatacacctctgtctacacaatttgtttttagtggggaaagatggagctacatttattacatttctttttaaaattctgatatgtacattataagaaaggatttctacaattcttattccttaacttatttcagaaagatttcttacaaaaaaagaggagggaggttggggaaaatttcaaagtcacaaacacacatcaggaagatacataaattattcaacaccaagagattaatgtaaatcagtaaacaaagcccttaagataatgaccgccatggaagccaatggcacctgaattaatattaatgaggccgggcgcgatggctcacgcctgaaatccagcactttggaaggccaagatgggcagatcgcttgactccaggagttcaagatgagactggccaacatggtgaaaccctgtctctacaaaaaatacaaaaattaaccaggcatggtagcatgggcctatagtcccagctacttgagaggcttgaagtgggaggatagcctgatccatgggaagaaccttaggaagtcgaggctgcagtgagccatgattgtgtcactgctctccagcctgggtgacagaacaagacactgtaaaaaaaaaaaaaaaaaaaaaaaaaaaaaactaaaatattagataatgataaattagggctctatgctgcactctccttcaggtgcctatgcatgtcaaacacaaatgatacccgtgacagcaagatttcaaaaataagcaagtatgtatatatacaccagggcacagacacttgaaatcagaaagtaatgagggcactattaactaaacaaaatgcccatatatcacatcacattcctgattttgtttgtatcaggaatgcgacgtgatatatgggttttaaaagcaaaaagactttcttagtgcacaatgcatataattggtgatggaacaaatagaaggaacccaagaaaacacaatgtaatggcagtgcttggggcatctgcttattcattattttcctaccattacaagaaaacactttgaagagaactcatcaagtactcgttagccatctactcagcaggatttcagagcagacttcttaaaccatgggtgataccctaatctccatcaggcactattagagctgcattaatccaggctaattctaaatccaagtgccattagcattctagagccaagaagcaaataggatttgctttctccaagacaaaactccaaggcaccacacccgctggaaaggtcactgcaggactactctttacatcactgcattacattctctgctgcaagaatgaacatgcatacaggcactgaccttcagatttgtccctgcaggaagtgcccacagaaatgaaattcagcaaagcccaaaataggcaggagccttttgtatctctcccaggctggagggaagctgagaactttaacgagctacacactttccaatgaccttgagactatttacatccttaaagtgataagcaggggctctctcgggatcatttagagtgcccgcttttctcatctgagcctttgctgataagctttgaattttatcttctgattctacatttttagcgacaattccctaaacttttatcttctcaggatttcaagccatcctcattctctttcacattttgtccaggtttcctttttccttgctgacatactttttatcctttgaagtttataaacaagctttaagataaagcagctttcttctctttataatcagttgtataccctttccatacttacccagtgcccatttaacaataacaatagcagtcaacacttgctgagcacttactatgagccaggtagtactctaaaccagattcgaaacatggattaattcattcattcttcacaacaattatacaaggcagatgctaatgagaaaaaaattgaaacatagtgaatttaattcacttgtctcagctcacactgccagtaatggtaaaagtgggatttgaacttgggcagcacggctacagagcccatattcctaaccacttaacaattccaagtctttatgaattctgtaattggcatcggtatgggcatcagaataacataccaagttcctaatcataacctaggagagcagtttagaaactggctctgcgtgaaaattagctgggcgtggtggcccacacctgtaatctcagctacttgggaggctgaggcaggagaatcacttgaacctgggaggcggaggttgcagtgagccgagatggcgccattgcactccatcctgggcaacaagagtgaaactctgtctcaaaaaaaaaaaagaagaaaagaaaaaaaaaaagaaactggctctgcgtgagaaacccatacgtacgatgatcctgaacattgtgttttcatggatctacagaaggaggaatggcaaaggtagcaggggtgcatggccactttctatgtagatctccagcccagggaagggcacaaggaaggcacaggcagatgctggcagccagcagcctcagcaacagaggagccaatgcagccagggcagggggaaacagctttctgtgaggaagagaaagggaagggctgtctatcccatcatatatcccatcataagcagggttcttgggagtgtgcatcaccccttttgtgagtacccggaggtggactgtaaagttttacttccctgagaagcatcctgctatttactcttaccttggggaaagaagactttgaaagctatctcctctatcattcatcagagaactaagattaaacaggttgcctcagttcctatcattatgctgccatgacacctgagattcaatttgctctctccatccctgtataacagaaaaggctttttcaggtgcatattttatagcttgggcttaggtgcctgtagaattgacttaagtatctttcgccacagagagcaggggctttgggaaaggctgctggcagagtatgagcaaacccagtggaggagggtggagactggggggtgccaggacacgtgtacaaagaactccagggcctggaactggcaacatagccatcagggttctctcagtcctgatgcacacgtaaacccttatatacctatttctgacaatatggcaggcagcttaaagggcttattagaattctaacttgctgacatttccctcaagcctggctacttcccttgtctagtgttttgctggtgtgcagtcatgccaatatccacacccaaatgtgtattaatttgagtacacctttgcactttatgtttagaaagtagaaattagtggctgggcgtggtggctcacgcctgtaatcctagcactttgggaggctgaggcgggtggattgcctgagctcaggagttcgagaccagcttggacaacatggtgaaaacccatgtctactaaaagacaaaaaaaaaaaaaaaattagtccggcgtggcagcgtttgcctgtaatcccagctactcgggaggctgaggcaggagaattgcttgaaacaaggaagcggagcttgcagcgagccgagatcatgccactgcactccagcctgggcaacagagtgagactctgtctcaaaaagaaagaaagtagaaattattagcagcacattaatgcgtttgctcaactttctagatgtcctcaaatgtttaaatagaatcaatactatatccgctttctataacctctaaaaagagaattaaattttctaaaaatcacaattatgtgtagttttccctagctgactatttggtatttacttgtcttcaacatgtagtatatctgatgacaggcagtttattgtgtgcactttatttttaacatcacctataacaattctatctgaagaaacagccattgcatggttagcccctctgtcttcagggtactcgtaagagggctgatagggatccccagtgacgtaggaggtaagctgagggccgtcaatttccattttgtagtgacccctaagaggctgtgacctccaggcccaatctcttatggcaaaggaagagggtggtcacatatacacaaagaagagattctgggatatttcttgaatgcaaaaccaaaaaatgtgtattcaaatctgactctcctttaatgcctagaacttccatgccctgacagatcagagataagttgacaaatcttagccaactcccctcttggctaaatagttccaaatgaagactaaagaaagcttctaagggaatcactacatttgctctatgatttgtgctgtctttaaggaggcagtttaaccaagtatttccctgcttttgttttaagcttctattatttacctctaacccatccacagcacttttcactcatttgtggatgaaacagccctctaaatactaaaccggaacaagtttataacaataacattagagctatgttcaggagaagtgtagtcaggtgagatattaagtcacccttttcctttacttagccataatttcacagttgaaatatctggatagtgtctatgaaacaaagtgtgtaacagaattctgatttttattttaaattataaagaggggttagaactgaatgcctagaaagtgttgtgttaatttttctcttcccagcttcctcccgctacactgtccccaaattataccttatctcgaaggaattattcaatctttggtctcttaactgaggcagtcaatgaggcagtcaagtcagaaaaatcaggctgaggaggccaataatcccatgtgatggtaattaacattgagtggcctcttctaatgtgctagaagacagtaagaatctgctcattgggccttcatccttaatgaggcagaggaggggttttgataggggggaaatgatttgttggaagcaaaaggaatgggacgcatcttgaaatgtcattttcagagcacctgggcatcctgggtgaggtaagaaattaggttctttacaagtccttagcctcacttcatcaagattgagctctggaggtttcatagatgaggacctacacagtcaaccagggttaaatgacttgcccaaggtcacacagcgagttagagagagtaccaaaattagaattcatagtctttgtatttctagttcattggctggtgcactagaacgaaaaaatattcggcataataaacccccagagccattcttttttgacttataaatgttgagcagataacaggctcagaatctaaaaagaatctgtttgaaacttaaaatttaaacacatagcccacagctatagtactagtcagcagaatgaaatgttctctgtgatcataccttccggccagcattaattaaaaagaaaagaaggaaatggtgtgggcttagaaatatattacatgtacatacaaggctactagctattatcactcatctagtttatttgatattcaatatttcattcaaaaatattatttgcacattgcactgtattagacagtggggctgtaagagtgaatcagacagatatttggcccctctatgtgtaaaagtagagtcttacagtagtcatcaaataagcaaccctctcccaaatacagtcaggttccaatcctctaggacgtgcctcttaccccattatttgtgggccattcttcccactcaaatccacaaaaagggaaacaaaagcacaggtgcttcagacttccctgacgtttgacatttcttgtgtgatagctaagaacaatggatgcatattgtatctctgcagggaactcatgtagacagtagtccccccttatctgtggttttgctttcccagggctcggttatctgctgtacagtacaatgaaatattttgaaagagagagagaaagagagaccacattcacataatttttattacaatatattgttataattgctctattttgctgtgagctgttgttagtctcttactgtgcctaacttataaactgaactttatcatatgtacgtacatacaggaaaaaacattagggtttggtactagcagcggtttcaggcattaactgggggtcttaaaacatatcccccaccatgggccaggtgtggtgactcacgcctgtaatcccagcactttgggaggccaaggcgggcaaatcaccaggtcaggagttcgagaccagcctggccaacatggtgaaactcccatctctactcaaaatacaaaaattagtcgggcatggtggcgcacacctgtagtcccagctactcaggaggctgaggcaggagaatagcttgaacctgggaggtggaggttgcagtgagccaaaattgtgccattgcactccagcctgggcgatagaatgaaacttcatctcaaaaaaaaacaaaacaaaacaaaacaaaaaaacacatcccccgaggatagcggggaaccactgaatttttactaaatgcctaagacatccttctttaatttgtgtaacatatcacccccttctctttctagtccctcctgaaagagtacttttctcagatcccttttcttgactactattaagaccctagaaagtagcgagcaagtgatacaaggaatctgcatactcaaaggccacatcacctagtttccacctttactttgtccagggtagcccgctgtgctctcagttcagtttagatgctttcttatgtggacatatcctaacatctgtagataactctccaggcctgaggggctgtcaaaaattcgggattttcaaaattctggtgtttcttgaagcaaattagtccaataacatagattcatccatcatggttaattaattttttctggcctttatttctaatatctcgctggatttccactgatataaagaaagcttaagatagacagaccctgaaatttactgtgctcctgaaattccattttgtatctaggaaaaccttcattcctctaaggtttcaatttaagaaagttctcctcaggggactgtaaagggacatatatagagctatgacagcaagtaccagggcactgctccgctggcaacacgaaaatgaaagtaatagcccataaacctatagacagaaaccagcactatgtcaaggagacaaggactacagggctctcgactgaagcaggagagggcaattaagacttcttactcctcgtcctgaagggtctcctcctcctcttggatctgtaactggttcttcacgggagctaggttctcggtcttggcgttgtagttccgaaagcagacattgagcttctcatcaaattcatttacgaggtcctccatggacttgaagctgattatttcggaagaaaaattctcaagctcggagagggaggggtcctcgagatggtggggagatgaaccatagaaacactggggcttctcctccgggtcctccgagcaggagggtcgaaggtcctcaaactcttcatccagactcaccagtggggcctccattcttgctcagcaggagaacaacagcgactttcaggatgagtttatctaaaagaaatgaacagcgtaatgtgagtttagaccaggctaatctaaataatagagttaactttagagacacacctgcttccaattccctactccaaaaaacaaggcactggttaagtacgaagctcctggacaagatcgtctaggtttgcattctgttctgtcctaccagctgtgaccttgggcaagtgattaattgctctgtgcttcttattcttctcaagacagatataatactgaacccacctcaaagggctgttagaagactaaaggagtaaacacaggtgagtgcttaaaacagtacctggaagataataagtgccaatattattgaatactttctgttggtgttttagtattattatttttattactattactattaccacagatccatatccttaactatgtgatctgaaagctgaaaattctccatgacttgtttggcagcaaaatgtgacatgatctaaactcatctggcaactaaacatgaccaacatgaatataaagctgttcatggctttaatttatcccattttgtgtgttttgctgcagaaatattaactttttaattacaaagattgctatcccagatcccactggatgaaatgcggaatgtacactctattactactttccaaaatctgaaataatctgaattccaaatgcctggccccaggggttttggataagggtttgtatacctagatattactacccttatcaataaatagtagaaactaataaaacattggctggatgtggtggctcatgcttgtaatcccagcactttgggaggttgaggtgggaggatcatttgagctcactcaggagttcaagaccagcctgggcaacatagtaaggtcccatctctatttttatttttttaaaaaaactaataaaacatcaatagagaccttccaataaatgcctgagttgtttttgtttcgtttcgcttttgagacatagcttcactctgtggcccaggctggagtgcagtggtgtgatctcagctcactgcaacctacacctctgggttccaccaatcctcatgccttggcctcccaagtagctgcgtgtgccaccacacccagctaatttttgtattattagtagagatggggtttcaccatgttggccaggctggtctcgaactcctgacctcaggtgatctacctgcctcagcctcccaaagttctgggattacaggcatgagccaccgtgcccagacaagcacccaaggttttcccacacatagagcatatgcctaggagcagaggaatagactaaatgatctattatcctgtatcctgtaagaaacagacccaactacccatgtgctccaaagccatactccataaccatcttgggcactgcaccctggaacgctgcacacacagaactcccttcagttcccaccaactgtgggacctctacccctcatcgggccatcttcatgcactgcttccaactgtgatttatccatctgtgtgtacatctgggccccattcaattttaacttaaattcctcgaggacacagaaatcctctggatatcttccctggctccaaatatacactgcctaccctgtggctaggcagtcaatcaatatgtgctcgttgaaaaaatgatctatctcccacatacagttttccattttcagtttcaggcagcacaagcattgctgactatcatacccttctctacacgctcaacagaaaggctaccaagcttttctcttcggtctatagggttattgatatagttaggtgctcaaattggaggcgcttcctgaggggaaccagacagcaaaattcatggattttgccctaggagtgcccattctccatctctacctacaaaactaaaactctaaataagcaaggcaaaggacatgccaggcaagaacactgccagtttgtaccgggattttgctgggattaagttgattaccgttgctttaaaacatatttggagcatttacagtttgcaaaggcaacatgataggacctttgaatacaaaaatatatacaagtagtaccatatcttggaaagaagacaggctcgagagccaacagatctgccaatggctggctgagtgacaagcatcattggtcctgatttcctcatttgttataaggaaggtgttggtacagagttaacatctttaggagttatttttaataaatcaataatttaattaatcattttgattgaagtaatatgtttatttaatccaatatatccaaagtgttaccatttcaaaatgtaatccacaaaaaaactaatgaggcagtttttattctttttttatactaagccctttgaaatccagtgtatattttccatttacagtacatctcactttggactagccacattgcaagtgctcaacagtcaaatgtggcctgtggctaccgcaagggacaacacagctctaaagcaaacacaagtaattgccagtcaggggttcttcatcttcagtacatagacccctgcaggctctttgaaggtaactatatttcaatgaaattggtttcctttacaagactaagtattttattttatgcatttaaaaacattatttggagaaggagcccacaggcttctccataccaccaaaggaggtcatagtgcaaaaaagattaagaatccctgagcaacaaaaaagtgagattagaaaagatggcagaatgcagtagagagtaaaacagttttcacagcccagggatttgtgttgattaaggcagtactctgtgatggctaagagcataggctttgggttcctgtcctggtcctgtcactcctagttgggagactttgggcaagttatcaacctcactgtgcctcaatttcatcatctataaaatggagtttaaaacagtgcttcccttgaagattactttttggactaaatgagatcatctttgaagtgttaagtacaatgtgcagaatatagaaagcatccaataaatatcaatcattctagaaaaatcaaagctgggcacggtggctcacacctgtaatcccagcaactggagaggctgaggcaggaggattggttgagcccatgagtttgaggctatagtgagctatgatcacactactgtatgccagcctgggtgacaaagtgagaccctatctttaaaaaaaaaaaaaaaaaagttaaaaataattctaggaaaaccaggatagctaacttacatagaaatgtgatgtgggggctgggcacagtggctcatgcctgtaatcccagcactttgggaggctgaggtgcgtggatcacctgaggtcaggagttcaagaccagcctggccaacatggcaaaaccctgtctctactaaaaatacaaaaaaaaaaaattagctgagcatggtggcaggtgcctgtaatcccagctacttgggaggctgaggcaggagaatcgcttgagcccaagaggcagaggttgcagtgagccgagatcatgccattgcactccagcctgggcaacaagagcgaaactccatctcaagaaagaaagaaagaaagaaagagagaaaagaaagaaagaaagaaagaaagaaagaaagaaagaaagaaagaaagaaagaaagaaagaaggaaagaaggaaagaaggaaagaaggaaagaaggaaagaaggaaagaaggaaagaaggaaagaaggaaagaaagaaagaaagagagaaagaaagaaagaaagaaagaaagaaagaaagaaagaaagaaaggtgatgtgggagtgcttcaagtaaaagaaaaattatccctgccatgatattctctgtgcaatgcttcaatatgcttatcaaacaagagaactattgctgaaagaattttagcatcttttttactaaggcttcttttttcaatttatttgttcaaaggttcctggatcgtgggttccattttacagagatatgaaagccaatccgatagtgttgcaggtatttacactgcctttaaatttgtacttttctctgggaatgacaggggagaagcagatggtgacaccagtggggtttctgatttgaaatgacacagtctatatgattaaccagcaacaagaggccaatccaaccagaatctaggactaagactgagttttgagtgttggcaacaggaagagtgtgctgaaagcactctgcccaggcagagtgtagagaaaatggattcatctagaaaattataaaagacgaaatgaatatcacagctctagggttcagacacatgctcatttgaaacagtccataatatagactgattgttttttgtcaactcattatccaagagccaagaagtgctgcatgaatgaccatctggagatgaagttaaagtgaaagccagtgctgggaaactagtcactcaacacccaaactgaatccagcatttgtggaaagacctcaggctgtggcacagatgagagtcaggcgttctgactggccccactatagcctccaggagggctctgtggattggggttggcagcacttccttagatggtgaccctgccttccttcctttagcccactttctttcgccctcctctcttcacggagtgctttcatccttcaactaaaatgtctgaaacaaccttattttccatcctggcaagcttgcaccatcctcattcatagctcatctgggagccttcttttccttaaagtaggattaatacaagcgatagcttattccctttagacttccaagatcaaaaataaatacgtacatacatgaaaatggcagaaagaaggaaccatgggagggtcgccttttctttttctctttaccacagaacagagcgcaggactatagtctgattgtcctacaatctattccatttattttcactcccaatagatggtgtaatttggaaaagaaaagacactcacggggcttaacagagacccagtaggaaacgcataaacgtctccctgcagcacaatgatgcactcgctgcatctcggggctgcggtacaaatgctcagtccctgctttgctgagctgacccgagtggagcggagcggtggagatttcaccacgctaaccccgctgggcctcggcacctccacacaagccccattccatctccttcttcccatcacttggtccatagatcaactgattccgtgcctcgtcccccatatccgtccctaaaacctaccctgcactgatccaccttcagatttcccactgctcctccgcagaacccacccagtgtgcatgtttgtgcacattttgacagaaaaagtatttcgttgcatatggatcagcaaccccttcgcggttctgcttgctcccctccccctcctcccgctgctccattcacctccatctcagatccccctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgccgccctgccttcacacgcgcgcacacacgcgggcacacacacgcggacacacacacacacacacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccg

SEQ ID NO: 1715 - DNA, 8111 bp, Homo sapiens
  source 1..8111: mol_type = genomic DNA
cacattcacataatttttattacaatatattgttataattgctctattttgctgtgagctgttgttagtctcttactgtgcctaacttataaactgaactttatcatatgtacgtacatacaggaaaaaacattagggtttggtactagcagcggtttcaggcattaactgggggtcttaaaacatatcccccaccatgggccaggtgtggtgactcacgcctgtaatcccagcactttgggaggccaaggcgggcaaatcaccaggtcaggagttcgagaccagcctggccaacatggtgaaactcccatctctactcaaaatacaaaaattagtcgggcatggtggcgcacacctgtagtcccagctactcaggaggctgaggcaggagaatagcttgaacctgggaggtggaggttgcagtgagccaaaattgtgccattgcactccagcctgggcgatagaatgaaacttcatctcaaaaaaaaacaaaacaaaacaaaacaaaaaaacacatcccccgaggatagcggggaaccactgaatttttactaaatgcctaagacatccttctttaatttgtgtaacatatcacccccttctctttctagtccctcctgaaagagtacttttctcagatcccttttcttgactactattaagaccctagaaagtagcgagcaagtgatacaaggaatctgcatactcaaaggccacatcacctagtttccacctttactttgtccagggtagcccgctgtgctctcagttcagtttagatgctttcttatgtggacatatcctaacatctgtagataactctccaggcctgaggggctgtcaaaaattcgggattttcaaaattctggtgtttcttgaagcaaattagtccaataacatagattcatccatcatggttaattaattttttctggcctttatttctaatatctcgctggatttccactgatataaagaaagcttaagatagacagaccctgaaatttactgtgctcctgaaattccattttgtatctaggaaaaccttcattcctctaaggtttcaatttaagaaagttctcctcaggggactgtaaagggacatatatagagctatgacagcaagtaccagggcactgctccgctggcaacacgaaaatgaaagtaatagcccataaacctatagacagaaaccagcactatgtcaaggagacaaggactacagggctctcgactgaagcaggagagggcaattaagacttcttactcctcgtcctgaagggtctcctcctcctcttggatctgtaactggttcttcacgggagctaggttctcggtcttggcgttgtagttccgaaagcagacattgagcttctcatcaaattcatttacgaggtcctccatggacttgaagctgattatttcggaagaaaaattctcaagctcggagagggaggggtcctcgagatggtggggagatgaaccatagaaacactggggcttctcctccgggtcctccgagcaggagggtcgaaggtcctcaaactcttcatccagactcaccagtggggcctccattcttgctcagcaggagaacaacagcgactttcaggatgagtttatctaaaagaaatgaacagcgtaatgtgagtttagaccaggctaatctaaataatagagttaactttagagacacacctgcttccaattccctactccaaaaaacaaggcactggttaagtacgaagctcctggacaagatcgtctaggtttgcattctgttctgtcctaccagctgtgaccttgggcaagtgattaattgctctgtgcttcttattcttctcaagacagatataatactgaacccacctcaaagggctgttagaagactaaaggagtaaacacaggtgagtgcttaaaacagtacctggaagataataagtgccaatattattgaatactttctgttggtgttttagtattattatttttattactattactattaccacagatccatatccttaactatgtgatctgaaagctgaaaattctccatgacttgtttggcagcaaaatgtgacatgatctaaactcatctggcaactaaacatgaccaacatgaatataaagctgttcatggctttaatttatcccattttgtgtgttttgctgcagaaatattaactttttaattacaaagattgctatcccagatcccactggatgaaatgcggaatgtacactctattactactttccaaaatctgaaataatctgaattccaaatgcctggccccaggggttttggataagggtttgtatacctagatattactacccttatcaataaatagtagaaactaataaaacattggctggatgtggtggctcatgcttgtaatcccagcactttgggaggttgaggtgggaggatcatttgagctcactcaggagttcaagaccagcctgggcaacatagtaaggtcccatctctatttttatttttttaaaaaaactaataaaacatcaatagagaccttccaataaatgcctgagttgtttttgtttcgtttcgcttttgagacatagcttcactctgtggcccaggctggagtgcagtggtgtgatctcagctcactgcaacctacacctctgggttccaccaatcctcatgccttggcctcccaagtagctgcgtgtgccaccacacccagctaatttttgtattattagtagagatggggtttcaccatgttggccaggctggtctcgaactcctgacctcaggtgatctacctgcctcagcctcccaaagttctgggattacaggcatgagccaccgtgcccagacaagcacccaaggttttcccacacatagagcatatgcctaggagcagaggaatagactaaatgatctattatcctgtatcctgtaagaaacagacccaactacccatgtgctccaaagccatactccataaccatcttgggcactgcaccctggaacgctgcacacacagaactcccttcagttcccaccaactgtgggacctctacccctcatcgggccatcttcatgcactgcttccaactgtgatttatccatctgtgtgtacatctgggccccattcaattttaacttaaattcctcgaggacacagaaatcctctggatatcttccctggctccaaatatacactgcctaccctgtggctaggcagtcaatcaatatgtgctcgttgaaaaaatgatctatctcccacatacagttttccattttcagtttcaggcagcacaagcattgctgactatcatacccttctctacacgctcaacagaaaggctaccaagcttttctcttcggtctatagggttattgatatagttaggtgctcaaattggaggcgcttcctgaggggaaccagacagcaaaattcatggattttgccctaggagtgcccattctccatctctacctacaaaactaaaactctaaataagcaaggcaaaggacatgccaggcaagaacactgccagtttgtaccgggattttgctgggattaagttgattaccgttgctttaaaacatatttggagcatttacagtttgcaaaggcaacatgataggacctttgaatacaaaaatatatacaagtagtaccatatcttggaaagaagacaggctcgagagccaacagatctgccaatggctggctgagtgacaagcatcattggtcctgatttcctcatttgttataaggaaggtgttggtacagagttaacatctttaggagttatttttaataaatcaataatttaattaatcattttgattgaagtaatatgtttatttaatccaatatatccaaagtgttaccatttcaaaatgtaatccacaaaaaaactaatgaggcagtttttattctttttttatactaagccctttgaaatccagtgtatattttccatttacagtacatctcactttggactagccacattgcaagtgctcaacagtcaaatgtggcctgtggctaccgcaagggacaacacagctctaaagcaaacacaagtaattgccagtcaggggttcttcatcttcagtacatagacccctgcaggctctttgaaggtaactatatttcaatgaaattggtttcctttacaagactaagtattttattttatgcatttaaaaacattatttggagaaggagcccacaggcttctccataccaccaaaggaggtcatagtgcaaaaaagattaagaatccctgagcaacaaaaaagtgagattagaaaagatggcagaatgcagtagagagtaaaacagttttcacagcccagggatttgtgttgattaaggcagtactctgtgatggctaagagcataggctttgggttcctgtcctggtcctgtcactcctagttgggagactttgggcaagttatcaacctcactgtgcctcaatttcatcatctataaaatggagtttaaaacagtgcttcccttgaagattactttttggactaaatgagatcatctttgaagtgttaagtacaatgtgcagaatatagaaagcatccaataaatatcaatcattctagaaaaatcaaagctgggcacggtggctcacacctgtaatcccagcaactggagaggctgaggcaggaggattggttgagcccatgagtttgaggctatagtgagctatgatcacactactgtatgccagcctgggtgacaaagtgagaccctatctttaaaaaaaaaaaaaaaaaagttaaaaataattctaggaaaaccaggatagctaacttacatagaaatgtgatgtgggggctgggcacagtggctcatgcctgtaatcccagcactttgggaggctgaggtgcgtggatcacctgaggtcaggagttcaagaccagcctggccaacatggcaaaaccctgtctctactaaaaatacaaaaaaaaaaaattagctgagcatggtggcaggtgcctgtaatcccagctacttgggaggctgaggcaggagaatcgcttgagcccaagaggcagaggttgcagtgagccgagatcatgccattgcactccagcctgggcaacaagagcgaaactccatctcaagaaagaaagaaagaaagaaagagagaaaagaaagaaagaaagaaagaaagaaagaaagaaagaaagaaagaaagaaagaaagaaagaaggaaagaaggaaagaaggaaagaaggaaagaaggaaagaaggaaagaaggaaagaaggaaagaaggaaagaaagaaagaaagagagaaagaaagaaagaaagaaagaaagaaagaaagaaagaaagaaaggtgatgtgggagtgcttcaagtaaaagaaaaattatccctgccatgatattctctgtgcaatgcttcaatatgcttatcaaacaagagaactattgctgaaagaattttagcatcttttttactaaggcttcttttttcaatttatttgttcaaaggttcctggatcgtgggttccattttacagagatatgaaagccaatccgatagtgttgcaggtatttacactgcctttaaatttgtacttttctctgggaatgacaggggagaagcagatggtgacaccagtggggtttctgatttgaaatgacacagtctatatgattaaccagcaacaagaggccaatccaaccagaatctaggactaagactgagttttgagtgttggcaacaggaagagtgtgctgaaagcactctgcccaggcagagtgtagagaaaatggattcatctagaaaattataaaagacgaaatgaatatcacagctctagggttcagacacatgctcatttgaaacagtccataatatagactgattgttttttgtcaactcattatccaagagccaagaagtgctgcatgaatgaccatctggagatgaagttaaagtgaaagccagtgctgggaaactagtcactcaacacccaaactgaatccagcatttgtggaaagacctcaggctgtggcacagatgagagtcaggcgttctgactggccccactatagcctccaggagggctctgtggattggggttggcagcacttccttagatggtgaccctgccttccttcctttagcccactttctttcgccctcctctcttcacggagtgctttcatccttcaactaaaatgtctgaaacaaccttattttccatcctggcaagcttgcaccatcctcattcatagctcatctgggagccttcttttccttaaagtaggattaatacaagcgatagcttattccctttagacttccaagatcaaaaataaatacgtacatacatgaaaatggcagaaagaaggaaccatgggagggtcgccttttctttttctctttaccacagaacagagcgcaggactatagtctgattgtcctacaatctattccatttattttcactcccaatagatggtgtaatttggaaaagaaaagacactcacggggcttaacagagacccagtaggaaacgcataaacgtctccctgcagcacaatgatgcactcgctgcatctcggggctgcggtacaaatgctcagtccctgctttgctgagctgacccgagtggagcggagcggtggagatttcaccacgctaaccccgctgggcctcggcacctccacacaagccccattccatctccttcttcccatcacttggtccatagatcaactgattccgtgcctcgtcccccatatccgtccctaaaacctaccctgcactgatccaccttcagatttcccactgctcctccgcagaacccacccagtgtgcatgtttgtgcacattttgacagaaaaagtatttcgttgcatatggatcagcaaccccttcgcggttctgcttgctcccctccccctcctcccgctgctccattcacctccatctcagatccccctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgccgccctgccttcacacgcgcgcacacacgcgggcacacacacgcggacacacacacacacacacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccg

SEQ ID NO: 1716 - DNA, 3457 bp, Homo sapiens
  source 1..3457: mol_type = genomic DNA
attcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaaggggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaa

SEQ ID NO: 1717 - DNA, 2604 bp, Homo sapiens
  source 1..2604: mol_type = genomic DNA
ttaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactcccagcaaggctgctgcctggtgtttcgaggctgctgtggtcgcagacagccgcctcgccttggctccctgtcaacaaggtgggggtgggagcgggagggaggagtggcccctgtcttaagagcctcacaggctgcaccaggagagcagccagcctgggccaggggccgccaggtcccgagggtggctgacccaaacgtcgtagatgcttttgttgggtggcaccccttggaagagggcgtctagatcgcagagcagccctgggggccctcgggtttcaggggccaccccccagtaggcagggctggttgacggacactggggacaggaggtgggtggtggtgccaagggcattaccacattgggagtgtagataggcaagtaggaggtgggcagctgcccccagagggaggccctgtgtcccccgctggaccgtcccccaggaactgcggtgccctgcagtaagtggagaggccaggccctaggctctggggagagggttgagggcccgatggctcccccctgcacagtctccccctccactctcgtggggccaggaagggggcagaggggccacagaggcctctcagaagagggaaggggtggggtgggcaccgcctcctccccactgttccctgtgcctgcaggaactgggctgctctgtggagctagccccggccagggtgccccctccccggaccctcctagcagggacttgatgctgaagccctcactgggtggtggcgggggactgggcggccggtatggccggccgtgcagcacgtaggggcccaggtccttggcgaaggctccacgcgcacctccgttctgccagcgccggcacagggcggtgttctgcagccggagcgcctcagctgggatcaggctcacgtcgaccgcccagaagttgcccttggcctggggctttgcagggtccttgggcacctgggtgtgggggtcagacatgggtggggctgcccaaccttggatgctcaggacttccgcgcgcgctccgcccccgggctccgaccctggcctgccccaccttgcggaagcatcggttggaggaaaggttgtggcgaatggagtctttccagccctcgtagtcttccctgaagaaggggaacacggcctggacctgacggatgatctgaaaccgccaggcggccggccggcgccgtgagcccagacggggagggggtagcgccctacccctcccccactaccgggctcaggggcgcgcggtgccggcccctgctgtccccgaagaaggacatttctgcgcggaagcgcggcagagagggcaaggggctcccggagaagggtcgtgccttgaggccctcagctctcaggactggtcccactggcatacctgggtgggctaggaaggggtgggggtcagggcttgaacctggaagtgggtggggaacgagtctggggaaagagagagtgggggccggggcccgctcacctgggccagcttcagtctgcgggagggagcggcctgaatcaccaaggcgatcatggccaagtaggtgtaggggggcttgtcatgtcgcaggtacctcttcttcctcctcttagggggctgggagggcgactctgcctctgggggccccaggcgggagccgctgcagggccccatgcgggacggtagacagcgtgggcaggggcctggccgggtggagggtgcagggcggtggggcagtgtagaaggcagggccgggacctgaggccgggctggggcaggcgggctggggcctttatcattcggatggaagggggaggggagggaagggaggaagaggctgtgggggaggggagcatgccgagggcttccacaattagcaggttttggttaatctggaagggaggggcagagagcattctagtgggggcttctcctgaggcctcagtctccacccctgagttgcctttgggtggccaggcccggcttcaaaggggctgcgatgacccatggctactttatcccgtcttccctggtcaggtttcaggaccccatttaacaaatgggggagtatttagcccatgccaagctcccaaggcgtggggcgctcctggagttcaagatctagcagctgctagtaggccctgaactatgggggctggatatccacccaggacatgatcaggtggagcttcctggaggagaaggccatgaagcccgcaccctaggaacaagagggggacacattgactcaac

SEQ ID NO: 1718 - DNA, 14217 bp, Homo sapiens
  source 1..14217: mol_type = genomic DNA
acggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtgtaagtacccggcatctgggcctgggtttaggccaaggcctgcggctgcccaggcaacaagaagaccagtcaccttaccgcccccagggacctcccagggcctgtcttgtcccctccaccagcaaacaagtcctcagggaccccgagatccagaggggtcactcctcatcccttcagtctgagcctgtcccagggctgtgagccccatcagatttggggtaccccaggtttcatggcagggtgccctcatgaaatcggggccaagggtaggctatttcttctccaccatttagggtcttcccagagctcagccatagaccccctttaccccagaacagagtagggtcccagccagtccccaggcctggttcagcctccactcacaggctcgctactctctgtctacccagaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctggtgagtactagtggccagcgagtgtcccatcttcccactgtcccagttcctagcagcctagaaagagtcagacctctgagaccaaagtcccaccttctctttgcagaccttgccactcaagaccagagagttggggcctcctggtcagctggggaggggtgttggcctggccagcatggaggggggcaagtgggggaggtaggccaggctaaagaagctggcagcttcccagaggctcctgagtcaggattccagtgtgtgacttctcactgtttgtttaaatgtccagaaactccagccagacctacacacccatatgcaaatgtgacaagaaaaacacattccagaggccaagggaaagggtttggggaggagccatagtacacagtttttccctccccagccttagcatacagagttgagagaggactttaagtgtggagggacccttcctggccccattctttgcccagagtggggcctgggtgtattcctggaaataccttggaaggttaacatgtccttccatagcctgacctccataagcggcgtgaccctggacaagtcttaacgtctctgagcctcatctgaaaagtaaggtcaacattacctgtctcatgggattgttgcttagggaagataaaagctaaagggaatttgctccctgctcccccgctctggtttggaggtccctgaggcagtgactgagtgggcgtagcctcagcagtgcctactccacatgcccaccagcccccctcacctcttgctttcaaacaggcccccattccagccccaagccaccccaacaaaggcttagaaggaagatggagaaggcggttgggtcctaccaggtgtggccaaaacaggactttattctggccctttgaccacttcttctcaggccccttaaacatgaccacagcctacagatagggcaccatcatctcagctactgcccccaaacctccactcaataacagctgccaatcattctgccaggtgctttctttcaagtgcccccatttaatcccctcaacaacactctagagagttcccaccatacccgtgttgcagatgaggaaactgaggctcatagaggccaagtgacttgcccagggtgtctcctaacctgcaaatggtgaggctgagattgagttcacacccttgccctcccacacatggagaagagctccagagacacacaggtatctggtcgacttgctgggtgaccttgggcatattgcttcccctctttgggctcagccccatcatctgtcaaatgaaggggttggacacaagtgctcttggcccttctaggcccgagattctatgattatggcaatctctgcatcaacaaccccagggcacacccagagagaggtcacagctgatttgcccctctgggcccagatgctggtttcccaaggcccctggtaaccccaggaagtgcaatccgcctcctccagggcttgtccaccttccggggcctagctgcacaccctcctgtccgtactcaccggagagctctgcactaggccctgggactctgtgccggcctctcacacatgggaaggcggagtctggccatcatggctagcagcagctgcaggctccccatgcccagtgtgagagcatccacaggactcacgcaggccagcaactgtgcagactccctggagcagggagcaaaagctctgcatcagggatggccaggagtcagagcggagaggagttactagccccattcagagatcctgctggagcttcctggggctgtacagaggaggaaacagaagggacccaggcccacagctggaccagcctgtctggccactacccatgctcccctcaccatggatcctcagggagagttctggagctgtgaccttttcctggtgtcctttgcacacctactcagagggtctgagacctctgagtcaggcgtgtcgagtgaggtcagcaccgtgcctttgtgctattccagaagatccctgtccctaccccagcacaagtctccctgacttctcaggacagcccagcctcagcctctcccctgccgtgaggggaggcgtagggactgctgtcagttccagccccggctctaccactaaattgctgagttcccttgggaaaatctctgcccttctctgttctctgttgttctccaggaataagctttgggggaagcagaataggggttgcttttatgtaaggttcaagacacaggaaagaggaagggagaaaataaggcctaatctagtcatctgctttctcttccagcagggttcagaggtcaaagtcaagcccccagttctggagagtggtgctgggatgttctgctaccagcctcccttgcagcatatgtactgctcctcccagccccccttccaccaggtgggtctggggcaagtgggcctgcttcccccaggtctgaggatatcgtgtgtgtgtatgtggtgtgtgggtgtctatgtgatggcatgtgttcaccaggataggcagataaggacagcagggccctgaaccttaggcttggccacagcaggtggcgggaatagttaatgggaagagaagcaattgccctcctccaggggtgggcttgtctgagtccctggcaaggcctgagaggcctcagataagagtgtggggctgagatggaggcagggctgtgatgtgagccagaaatgggggaaggaggagagctgccccagacagagagaggggcaaagaggagtgtggtgtgaaacacaggccgagcaggtcgaggaacaagggcttctgtatagtcagccaccatcttgctatgtgaccttggcctccaacttctattagcctagaaagggtgggcacccagtgtgggcttaggggaccttcccacccagaggactccaagtccccatcatcttcagccctttcctcctttcccagcttcagctcctcccaagtgtataggatgccaagtaattgccccacactggcatgggatggaggagttttaaaggagaaagaaaagagccccagagcagccaggcagctcccaggagtcaccaggcaagacagagcaagtggctgcccagcgcccagctccatccacctgcagcctggcactgagacaggccctgcctgtggagcaggttctgcacccggctctctggcactggccctgatctcagccaagccagggaggaaggcaagggagaggggctgggtcagactgctggctttgcagggaaaagaaagagatagagggaagcaaagagaaggcatgagaggacatcctctctgccatgaggggcctgggtggaatgaccgaagctatcctgaggctcatggtctgacccagggtagaggatgtccctgaggcagggacagagattgagccacagaaggactaaggggccaccagaccttaaatgacctcaccatgcctggccctgctttgatggcctctgcagtctgcaccccctctcaagatggccacacccagggctttatggagcctggaccgaggtgactcaggcactaaatgtctcttgggtaacctggaaagagctcttcagcctggagcagctgggggagtcagagtctcctacccccatcccccataaaacaccatccgtggcaccgcagccactccctttgccgtaaaaccacctcctaccccgacctgtccaccaccatgactggccctttcaaagagccactgaaactcataaaaggtggcagtgcccagcaaacgcccaggctggacatcctgcttccggcccagctgctctgggagatgcacaggcactgggagcaccttcctggaagggtgcaggggccgagggcttcacttcatactctccctgcagggtcccgtcaccatagcaaccagagcatcaaaagggctgagaggaaggagctggaggaagagggttttaaggcctctgagatcctgaattacagggtgtggatctcctcacagcccctcagacagctctgctttgggggtgatggggcccatgacccaggagggaagaatctggcctgagccccttctctggatgtatataaatggggaggagggccctcctgggaaaggctgggtaccatgcaatcactctgccccttttgacctcctcagtactcgccaggtggtggcagctaccccataccctacctgggctcctcacactatcagtaccagcgaatggcaccccaggccagcaccgatgggcaccagcctctcttcccaaaacccatctattcctacaggtacatttcccactctccagggatgggaggaggaggggagtgagagggcccctgggaacactgaggcatggaatcctctgggtctaccagtaatggcagcaggtggaaatcataccagtgggcttccagaagatgctggagagagggttcctgcatgaaggcaggggcatagactggatcagctctgaccctttgtctaagcctggggagtcatgtctgtgacttgactcagcagatgctggtgccatgtgatgagcctgccaaggtctcacctcctagggcccagggcctggatctgagaatttaagggggatgcttgctgccttccctgtgcctccccggaaacagacggaagcccccctcaaagctctactggaaggaaatgggggatgaggcctgcagatgtgactcggctatccaccatctgccagatctggtgggacttctctggggctgggttcttaagtgtcagcagacccagcctgtctgggagacccttccatctgtcctttcattcatccaaccaacagtgacacttggccaaatatgtgtcaggccctacatgggatcgggtcatcagctagtgtgagctgaggggaagggagaggaacttaagcatcagccaggagtgcagagaagggctttgtgaaaggcaggatcattcactgaaagacatacacgcagctcttggagtccagcagaaatgagttcaagaccagctgtggaactgaccagcatgaaacctcagggaagttacttaatctctctgagcctctatttattcctctttaaaaaaaaaaaaaaatgtcaggggttgggggcaaggggagggacaacgttaggagaaatatctaatgtagatgacgggttgacgggtgtagcaaaccaccatagcacgggtatacctatgtaacaaacctgcacgtactgtacatgtatcccagaacttaaagtataataaaaaaaataaaaatataagacttttaagattcaaaagaaaaaaatgtcagggtttggggtagcagttcaggctgttggaaggattaagtaagagaatgtaggtactgtgcttggtacattgcataggctcaagaaaccttagttccctccctactctccaacattcatgcaattggctgaggactaactagtaatgacagcttccgtttaatgagtgccttctatgtgacaggcaccatccttaatcctcacaactctgaggtagctattactttcttcacttcaaagttgaggaaactgaggttcagagagggtaaggcattcacccaaggtcacacagccagagagtaactaggccaggatggccacccaggtttctcagattccacaagaccctcgcacgtctgtaattcctgacttccgtgctcacttcaatggacaccttctcattcccttctctttcacctccaatcccatagagcctctcaccaggggtggggggcttggggtgggctcaggacccagtcagaggttcggactctcaggggctttctctttcttcagcatcctcatcttcatggcccttaagaacagtaaaactgggagccttcccgtcagcgagatctacaattttatgacggagcactttccttacttcaaggtgagcccaagattcctccccatcccatcacccccaagtcctggacaggccaggcctctctgagcagaggcttctgtctggaggtgggagaagaattagaacgaaagccaggagagggcttacccccaccatgctttccgttgtctccacctcagaaggacagagttcctacaaaaggtgctccaagtggggaacagagagcccaagtggctcatccaaggttgcacagcagactggagtcagaccttctgctggggaaggtgggcaaggtagcaccgatgggcctcagggagcatccacctaccccaagtgggaagagaaagttggagaagaaataagacactattgctaccccgaccgctgggatgctgtggggctggagaagctagtcagccacggtgactgggaggtcggggctgaagaagccattgccttccaaggtgagattaggatctatctctgtgggtggcaggctcagctgcagttctgccagaaagcggggtgtgggcttcccagtctttgagtgtcccaggctggctcacctgactctcccccaaccccttgggcagaatctcatttctatcattcacagaaggcgcttctgggagccttacccagctccctctctagaggcaggacaggggctcttctcccaaggtggacaaacacatcagacagggtggtccattcccctaaggtcgcacagtagatgggatcagttactggatcaagctatttggctttgcacacccctctctgcgtgccacctagaccctccagcacagacccccttctcctgggatgggtatcagggagaccagagattgtgtgtgaggagtgccttctccaagccctagtagacacaaatctcatctgtcacccaggcagtgggcagttgctgagacccgggtaatccagaactcagctccacctgccagggggtgattcctgcccccaccatctatggtcctgcctggggataatttgacgcttgatgttcaaataagtttatcctgctgggctgccatcagatgaggagtgggcaagttggccggagtggtctgtccaggagtggaaaagtgtgttgatccaccagaggttctggaagggaaagagggagggaggtgagtcgtccctggaattcaagaagcatcaaagcctgaattcagggctgccctccataccccagcaggtcaggggctgaactctccctaacccctaaagcttttggagggtcttctagggtttcaaggggccagggcagagagagggaaaagcccagtcctctcagccttccttccccaccagctcccggcctggcccccacccctccccgcatctcatcttcctggcttaattatttttcctgggagccatgtaatccctgttttatggggctgaggagtgaagaggtctaacagctttttgttccctttggttctagttgttgcttttagccacttgcatcactccctcactcctgagtttacatttgatctcagagagaaagcatctgtgaggatgggatgggccccagattgtgaggcaggccctatggggtgacctgggcagggcccttagctgggggacagagttggaggctaagctctgtcactgcctccttgtgtgatccagggctaggccctttcttctctgaacctcagtttcccagtctgtaaagtgggtcagatccgttggcacatagattccttctgactctgacagttcccctgtgacccacctaaggaaattccttagttcaaagatcccccacctctttccatctctcacttcccttttgaagatcatttttctgggcaaggatagactggaccctggagtggccagcactcatgcccaaggcagctgctgtgggcatcccatagccccatgagtcagggatgtggggctggggaagtgtccagccactggacataattgttagtgctgaccatccctcttccaaacaggaagtggctggggtgggggctgccctggcatcccaaagtcacagattcatggggccataaaaggccccagcgcccattaactccgcccatggggcaacgtggccttaactcctagtggagactgtggtgggagtcgaaggtgaatccctagttggctggtctggtggctcaagaatcctccctggtgaccctgggagccttaggggtcatctcaaccagcaacctgccccaggccagctgcccccaagaaaggctgcaccaggtcctgccagccacttggagtgacgctggcatcaagacccagttctgctgggcatgattcagcttggctgctccctggggcaagtgagctgaggaggaaggagtggccgcccctcattaagcagaaactttgggctgaaagggggaggggccagggaatgagggcgaaggagccccaccggccagagcgagtgccctacccacagtcagcccctgctgaactcagggctgtcacagagcctggaacagagctggaggtgggcgggcagggggcccactggcactcccgccaccgcctctcacccaactgagtcagcctaatggtttttacaaccctccctgggcacaattaccacactggtggcatgaccaggcctcctaatgggtgtttattctattggcacgagcacccccccccactgcctgagggctggcctccccaccagggcacgccccctgggcacactcatgcaaacactcacacccacacatcatacgatcatggctacccacagtcacacccagagagactttctcacacacagccatcctcacagtcgaggaattcatggacccatgaaggagtatccaggagacgttgcttatgccaggatgacacacttagggacgtatgcacatgctcatacgcactgtcccttcatataccaaacccacttagacacacaaacatatgtgcaatgcacacaccgcacacacccaaacactcaccaacctcgcccatctttcttttctcccaagttagtcccagaggggataaggcagacccaggagaggagcattcttcccctaattcccctgtctaaagccagccacaagacctcagagtaatgagtcccccttccacagaggggtccaagcacaggcatggagacccagtggggagtggctcagcttcagatgggagagtgttgtgggtcagaaggcctctgtagcgcccaccagccctggctttccgaatcacctcggcagtcctctgaggggtcaggaagggatgcgggtgggatgaaggcagatttgagatgaaaataacttggggtcaaggttcctgttcacccgtcccctaccaccaaagggtaccaagcaagggatgggtgctgaggaggacaacaagccccagagtgggcggcagctctgtgcccagaggagaaacaggagtgttctagaacccagacctgaagcccgctctggcttcctgagcctggcctgaatgcttgtcttgctctgttccggcagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccaggtgaggccggccgggccacgcaaggaagggcccagggtactcatgagccaaaaaaaaaaaaaagagagaatcagagaatgaggcaaggccccgagtaagggttccagtctggggaagactgtggaggagggaggtctcatggtgttctttctctcttgggcctttcagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggtgagctgggggtgggaaagggaaggtgggacaggactggagaggagcacctggcagtgggactcatcttctccaagtctccagactgcagcctgcaagtggctgggtttctggtcaactgaagcagaggaggctggacctggcagggggagcttcccacttgctctctgccatccagagaatggggaaagagggatgtccttgcccctgtctccctcctcctggtgctccaaacatggtccaactgacctcatcatcaaaccactcttggcagggcacagtggctcacgcctgtaatcccagcactctgggaggctgaggtgggcagatcacctgaggtcaggcattcgagaccagcttggccaacatggagaaacactgtctctatttaaaaatgcaaaaattagctgggcatggtggcatgcacctgtaatcccagctactcgaggctagagaatcacttgaacccgggaggcggaggttgcagtgagccaagatcgtgccactgcactccagcctgagtgacagagcgagactccgcctcaaaaacaaacaaacaaaaaaaccactctcagctctggagagactgcaaagggctccgtgttctattctatactcgattgtgagtgaccagtagtctgaacattctcagatgcatttgcattttatcagagttcatcttctaaagcagaaggagagagactctaccctagaggaagagtctcagagctgggcaagtcctggagagatttggagataggagtttggggagggttctacccattccactccatcttggctgctccgtctctgcagatggctaagcccacccattcccgtctaaattccagtgcatcccaggccctgatactggccacaggaggtttggaacggggtgacgacccaggcctcagactctgtgtgcacaggggtgggggacattcacaagctgatggaggcagcctgtcctcagagagctcccaacccgatggggagacaacccaggtttaggaagctattagaaaagtgcacatagatcctcagcccagtccagaagtggggagcagggctcaatcagcctcagaggaagctatagacatgtgggatacgaaaaacatttacttgatcccctgctaggcatcaggcatcaggctggctgctctctatgtgctttctcatctgggcctagaggataggaaggattattaaacctgcttcatggaagcacacagaggcttgagaacttactctaggtcacttagctagaaagagggagagttgggactggaacccaggcagccaaatccaatccagggtttagtcaggccctctctctccagagcttgcagcctggatacccagtgcaggagccccaggccctggtcagccatgatgagggtccacaggtggcagcactgtttgctcctcggactcaggtgtgcatcctggctctgctcccattccctgggccctgcagtggaggagacccagggagccatgcccatccatcccattaggtccagagtacactgccggaagctgcttgatctgggctgcaaatctaccttccttgggagactgggcatgagccagggttcactcccaagtgcacaacattggcatccatgctgtcagcctgtcagcaggcatcaacccctccccaatgcccaccccccaaaaagaaccacagaggtcatctagatcgacggctttcagattgtgctacacgggaggaggaatctgaggctgagaggttcagcaactgcctggggtcacaagctagtgccaggctctgttcccagcacatgtcaccctgacccctgctctctgcagcatgtgaagattgacagggaggaggggccagacagggctcctccggtgcctcccagtgacacctgttctctccttccccatctaggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatgagctgtgcccagcttcgtcagctccagcgtttgcctggtctggaagtcctggccggccgcccacatcgggctcaccttaaaggtcaaggaaggaaaatactacctgtcccctatgccactaagccaacgtgtgtgtcagctggtagctgggggcgcagaggacatcacctggggtgctgcctctcacacatttctgccacgtggtggcccagctcctcacccagggcccccaaagagcaagcgtctgggcaagaggaaaatgccctgtccctagctcacactcatccacacttaagccctcgtgcacacacacaaattattcagatgtacacccacccacatatcttacagccagaggaaccagcactccatcactgagagcccgacttcgtttctggggcaactgagagctgagcgctttgcttaccaaaagctcagggccctgtgccaggccaaagatccccccagacccccattctgacatccacatgctctgcagtcctggccccctcgtcattttctttcccagaagcgccctgtatttattcccccatcttcatcccaacagcccagcaagaaggaggagacagagagctcctccctgggttgtctgtggacccccccaggagctgctaattggcagcacccactcagccattctctacccatccttagtacatgctctgtccagctttccccagggtgacatacagaaggggcaa

SEQ ID NO: 1719 - DNA, 14392 bp, Homo sapiens
  source 1..14392: mol_type = genomic DNA
tgtggggagctcggctgcagtttattggggacggtactgtgggttgggggccttggatcccaaataaatgagtagttcctctgcagtctaagctgaggcatggatcagggctcagggaatgggagtgaggtgagtggcaggggagacacggggtatttttggcaaggcagtgtgtgtggctgtgtgtgtctgcacgggactcaagagacccactggggggctgtgcgtgtgcatatgcgtgagatacacaggtgaattctaacaggccgtgtgtgtgagcgagcacgtgttgggacctcagatcctgagggtactgacgctgcttctgtgtaggcctctgggcacacccctgtgttgacagtgcccctgtgggccctgaggctggctgtgggtgcgtgccttggggtgtgtgggttgtcagggctgtgcttgtgtgtgattgtgtgatgatgcagctttgaggttgtttgagtgtactgaggcaggctctctgtgttttggggtttgtgttgagtgagggacaggattgtgacattttgtgtgtctgtgtgacttttccagccctgaagtaatctgtgcgagcagctgaggcaggctctgtgtggctggttgtgaaggctctgtttggctgcagggctcgactggggggtgtgtctggggcggaggtgggggctggggccaggaccggggcccctctgagcagccttggggcaaaggatatgatgggggagggggtggctgccagcgggggaacaggggccctggcaggcaagacagtggaaacctcacttcttggtccctgtgggcacatccagggcctatcatccctgcccccaccacctctgcctcccaccagtttggcccctgttcgtccatcctcctttccttgatcttgaggtcaggggccaggtgtagggttggaacacctgctgggcctctggctccgtttcttgcggaactccagctcatccacggtccacacagcccccttctcgctctccacccgcacaaagcacttgtgcagactcaggttgtggcggatggcgttctgtggaaggccggggacagggagcaggtgggcgtcaacctctgaggccagcagccaccaccaacaacccacatcccgttcctccccaatgtgcctatgagcccagacccaggcctgcccactttgagctgcgatggcacttgaggccatcccagtcaccgccacctcagaggagctcaccttccaggtggcaggatggtttctgaagaaggcaaacatgcgtgtgaaccagtggtagatctcattgagtgtccgctgcttctctggagcctccaggatggcctggaagttggggggtggggtaaggggcacattccccaaacttggggtttagaggggctatgacctaccccgagccatctgacatgggggcggaattgtaggggcaggtaatcagggacaggactagatgtggggtgaagcatggggtcaaagatggggttagaaaaggggtgaagtgtcgggttgggcagggttagatgggtgtgggtatggttgttctgggattaggtaagggatcaggactgaggttgggagtggggtcttgttcagggctagggctgaagtgaggtgaaaggtctgggatggagttggagttggggttctctgtggaggtgacatttcagggttggggaaggtgaagggtcagaagtggggtcaaggatttggaaggggtaaagggccaggccaacttaagggtcagggaaggggtgggttaagagtcaggctggggtggactcaggtggggggtctaggggtgagggatgggatgacttggctttaggtcagaagccagagatggtttgaattatcgagtatcttacgtgtcagggacatggttaggtggttaggctcagggcaaggatgaggttagttgtggggttcggtgtggagtgaggctgagggtcagggaatttgatcagtttggattcaggaatgggattacagagtcagcgatgatgattgcagtgaggctatcagtcaggatggggctaggtcagggtttcagttcagagacagtcggggaatatctggtatcatgtaggggtgaggttcaggtttggggttaggtgtggcgctaggatgaaggttctgagaaggcattggggaggctgagatgaaggagttgggatggggtgatgaagttaaggatcaaatgggtgttacaaggaaaggttgggaatggtgcccagttgggggtgtattgacatactggggtacgttggggccagggaaggagatggggttgggttggcataaaggctggggaaggagttagagtaagagctggggtacgtttagggcaaggtgcagagatggggttagctttaggctattttatgggtccaggagagggttaggtatggggctgaggtggacatctggaaaggggtaggtttagggtcagaatttggcatgctctggcctggatggtggtttaggtttggatttgcggacaggtttggggtgaagccagcatgaggggtcacatttgaggcacggcttggggatccttggggctggggcttgggaatggaggaacccactctgagggcactcagagggagacaggagtttgggaggcaggtcccccaccccatctttgtcttcctcctccttggggccgagctgccctgcttacccagcggatgagcgtggcgtaggtgaaagggggtcgcatgttgtggaacttgaagtagtccatgttgtggaggaactctgtcagagggtggggatgaatcaagccccatgcaggacctcctagctagctccctgtcccctccccctacaaggtgagtctacaggcctgagatctcaccgtcaacacccgtgtccacgggcacaggtactgtttgctgagcacctgacataagttgtatcatttattctttgcaccacttctgccaaaatagttctccccgaggttgaaaagaagcggagtaacttgcacaccaaaggatgcaagaggttaaatggcagagccaggatgacagtcaaggtctctgatccctgctaagcccacaggccaggcctggtggagagcagtggataggtgagctcgggcgaatccaccccgattttccttggtcaggggaggaaaggaggtgctcctggaattacttagcagggtccctcccttctgatggccgaatatagtagctggagtccagagtgggtgaggcatggccccaatccccaagggagtcagggctaggggcccgacactcgagaccatatggggggctttcaggccacggacatcccgaaaggaagcttttgtgagcggatgcattttcccaaaggctgagtggcggcagctgcagtggtggtggtggtgggaaggggcagcatggagctcctttgcaccctccacccagagcctgtcaggattaggagcttgggggcaccgtgtagtgcaaggaccattcttacctgggaatgtgctgtttccatggctaccccacaggtgcctccggacagcaaacaggctgtcaggggcctcccgggggccagaccaggctgggacgacagggccttggctgccagcagctacgatgcagcaggagcccttgtcggatgatgcctgggtgagggggagaggctggtgacccagaggcttaaacttcccactttttactttctattttatgttttttattttttttgatactgagtcttgctctgtcgcccaggctggagtgcagtggtgcaatctcggctcactgcaacccccacctcccagattcaagcaagtcttctgcctcagcctcccgagtagctgggactacaggtgcccgtcactacgcccagctaatttttgtatttttggtagagatggggtttcaccatgttagccaggctggtctcgaactcctgacctcatgtgatccacccgcttcagcctcccaaagtgctgggattacaggcatgagccactgcgcctggctccactttatttttaaatcagtgtttttcaaagcaaggacgccctcttctaaattccagtctgaggtggaatcccacaaaacagcatgagccgtatttattagagcacaggtgcggatgtcgtatgtggccactgatgctgggaccatgaactggggttgaatagggctctttaccacccaactgtgaccttgggaaagtcacctaaacccccctggcctcaatattcctcatctgtacattcgcatcatgagaaataaattaccaccagcaaagcgctcagaaacagtgcctggcctccagggctggcttcatgggcgtgtgacctatgtggttatgtggcaccctgtgctttgtttaatgctctgtggtcgccatcttgaaatctgaacaaggggccctgcaggttacatagctggtcctgctggcacacagcctgcatctggcaagtctggctatttgcatttgctttaacaactcaggatcacagtgtttggggatcttagagtcagagggttttttttttttttttttcttgagacggagtcttgatctgtcgcctaggctggagtgcagtggtatgatctcagctcactgcaaactccgcctcccaggttcaagcaattctctgcctcagcctcccaagtagttgggactacagacacctgccaccacgcctggctaattttttgtacttttagtagacacagggtttcaccatcttggcgaggctggtcttgaactcctgacctcgtgatccacccgcctcggcctcccaaagtgctgggattacaggcgtgagccaccacgcccagccggggtcagagggtttgtaagtagaaggggacagatttccaggtctgggcatgtttggagctggggacaggggcccctagctctcaggacctgaatgtgaggttaggttccctgcaccgtgcagacctcctccctgccccccagcagtctgagtctgccaccaccagtcctggggtcgctcaccacagatgaagccttggtcagtgccattttcccagccaggtgggcctgcatggcactcagcttctccttctccagcaccagctgtgaaatggcacaaacatgaggcctcagcctggcccttctctgccacatctttgcccaggctacggtcttccctgggagtgcccgctcctcttccttcctttataccagccctcgtcccaggtgaacttggtttctggcacatggtggacagaaggttttgcgcactatccctatcccttaccctccaccgccctggcattacctgctgctccagagactgtaccatctctctctggaggagacattgtgccctgcccttctcatccagaagatggtccgcctggcagtgcctaagtagggagaagattccatgcaggtgaccacgacaggcctggtctggctcaatgctctgaatggggagggcccagaccctctgggagttctctcctctgagccccagctcccctcccctctctacctcagtctccctctcacacccctcgttcccttaacacatgcccctcagcacctactgcatgtcaggcctgaactcaccacttgagcctggccagagtgctggagataatgttggaagtgtggtgagttgagaatgggccagggaggtgagagtgggcaaagcattctgggtggagggacggcctgtgcaaaggcctggctgcaaggaggacaggacatgtggggttgctgctaagggttgtgtgtagtgtggtgtgtatttgtgtgtgtgtgtgtgtgagagagagagaaagagagagagagagagagagagagagagagagagagagagagagagagagacatatggggggactgaggggaggcagcagcagccatctagaggagctagaactttgggaacagtggaataaggctggcatgttggcatgaggagtagcagggcaaagcaggagtgcagattctagagcctggctacatgggttcaaatcccagctctgtcactcaggaactgggagattttgatcaagacacttaacctctttggcctcagtctccttgtctgtaaaatgggggtaaataacagcacaaacgtttcttattatacatacgagaaaactgaggtcgagagaagctaagtaatttgtccaaggtcacacagccagtcagggatggagctgggatttgaacccacagtctcagagtttagctcttgcatcttactacttattgggatgaagcctgagctgagatctgcaccctagacctctccccacaagccagggccggtagactggcacaggcctgggccactcacttgaggaagtcctctggctcttcgaagaccttctcacatccgggccacttgcagacaccatttgccagcagtgggtaggagctctggggcacagccgaaagggtgctggggggacagagggtgtcaggggaggggataggagggcgaggatccttcccagccctgtccactgacctgtccttcctgggtgcactgggatttgggaaggtgcagagcagtgccggctccctggacacccattccaggctggccacgttgatccctgtgggtggggacagggcacctatggaggctgtgggctgggctctggagcttggcccacaaggcctctcattttgagcttcccaccctcctgagcctcgaaaaccctgactcccagggggctctgctgtccccaaagtcccaggcttctggcagagaagcttaaagacggccattcgcaggtgctgacattttgactagctttgtaaagctctgtggttttgtgattttgacattctgcatctttaaggttctgcacctgacgttttttggagggtggagtttccaagcctctgagacctgacacctttgacccccagagtactgcaattcagaatagcctacactgctcacagccaaggatctggggacttgggggttctgtgaagccatggggtacgggctgaggtgttaccaggtgggaggccaggccgggccttgagggagaagaccccagtggcggtggtgggtggtgtgaggctgatcatggctgggctctccagggggtgcacctgcagcacaggggtccgggcgtgggcatccaccgttgagagctggggggcacatgtgggctgtggttcagcctgactcggggcccctccccacagttctcccacctgctccctcctccctgcccattcaccgtccatacctggtgcatgaaatgtggcctgtcctggaggagtgcctgtaagtggggcaaggggcccagccgtgccccggagggtgccaccatgactaggggcagtgtgggcagctgggcagaaaggcaggtgggtgagaggccatcctgatcctcactgttctgtgtctaattcaaatactctgcactgcaagcccacatggtagatgctatgatcatcccccttttacacgtatggaaactgaggctcatggagatcgagtaactttttaaagatcaaacagctaataagttgcagagctggcctcagccctgtcacctcacctacttggccccagtcctcttctcttgtcacatggggatggggacacatagctatgctcatgggactacaatacggcctcctcctctcctgagacagggattgggaggtcggggagagcctccaatctctgaggcctggcaggtggggattttcttggccctgcaacatctgcataagtcacagacttgcctgggacccagaaaccacttcctgtgccccagccagcccccctcccgcccagtgccacagtaaaggtcggcacctgtaggtccaggtaccccaccctgcctgccccatcctgggcccagggcctcacctgcagctgcgatggtggcatggggttcaaggaagaagaggaggcatgggccccgcctcgaagatctcggccctggaaggttccccctgggccccgggcccccagcaggtctgaggctttgggtgcagccctccagctgggcgaggctcctggggatgggccaagggccaaggaaggggccgagggcttgccaggcctggggttgggcatcgggtccttgtccaagggcaggctgcgtagacaataggggaaaggagtcacacgtgtgctagggcggtatgagatactcgaccacctgagccacgtggacactcctctggtcaaagcaggcattggctgggacatgtcccgaggggccccatagttgcaccccagctctagacacacacacacacacacacacacacacacaccaagaacacaggtacatgtacatacccacacatgccccacgtgcagaggtccagcacctggcttgcctgcccacgctagcacagccctggtgtggatgtgtcctctatgagggcaatggttgtttccccctccacttgagagctgtttcaagcctcaggcctctagccctccctgcaccctgcacaggctgtgtttgctcatcttgccggagctggtctcggactttctcctcggagtcctattttgccccagtgactaggcatggactcaaaagattcatctggctgctgtgagtggggctagtgaggaggctattgtaacagtcctggcaagtgatgatgctggcacagaatgggctggtggcagtggagaaggcgagaagtgggtagattctgagacttaatctgaagctggatcaggagcagtgctagcagcttggatgtagtgggcaagagggagagtcaaagtgacatgggttttagcttgagcagctggaaggaccgagctgacattacctgagatgggggacatggcggggagttggattgggtgcaaaagtgcaggtgtagatagacatgaagagtctggcattaaatatgtgagtggaggagctgagggggcagctgaatacgggggtctggatctcagggcaaggaggcgagtccaggagtgtgatcatgcacggatccagcatggcaagtgacagagaggaggagagatggggtctcttgagctggggcctgtagaagcttctctacccagcccccatcagagttcaccccaatttctggccctcaagcctggctcatgctacaccccctgcctcaaatgcccactccttctcctctttccctgtccaagccacgcaagacctgctcttctattgtcctcaccttgaaagccctccacaatggctccgggccccctgctgagccccagaaccttccactccctgagggaagcactggcttttcaggatcctataatcctggtctgagaggaagccagagctggaagggactgcccagccaaccccattatacagaaggggatgctcagatgccgagttccgtagtcccatagtgacttgagaactccacttctttctttaggaagtgtttccgtgtgcacattttataaactctctggtgtgtgtgtgtgtgtgtctccatctccccgttccacctcacagcactgagttgggcacacagctgctgagagcagcccgggggagtatagaagggttctgggggagcagttgctccttcctttctttgctgtcacctcctgggggtggttgtcagagctgtggtgctgagggagatgagtgtgagaatccaggtattaagttcttagtctcctgggggcttagaacattactgcgtgagaaacaggagtgtgggtctgtggaggctccgaacaagggcctgggagagcactggtgagatgagaaggtgagtgaatgaatgaagccagagatggggtgatgctccttcaagccaagaaataacaaagattgccagcaaccaccagaagctgggggagaggcctggagcagcttctcccttatggcccccagaaggaaccaaccctggcaacaccttgatcttggactctggcctccagaactgtgagatgatcaatttctgttgctgaagccactcagttgtggtactttgttatagcagccagaacaaactaataccgatttcggtgcaaatggatgttttccaccactctggcctggcccatgtggctggcctgtggtcacttctgaagctgcctggacacttggccagagctaagaattctccccaaacacatgtgggatggcctgactcagcaaagcatagatacattctcagacagggacatggagatgatctgtctgggggtagaggacctagagggccgggctgggcagccggcttcctgcactgtctgttgggacgtccctttctgactgggtttctcagaagctgaatgggggatgtttctgggacacagattatgttttcatatcggggtctgcatctgggccctgttgtcacagcccccgacttgcccagatttttccgccattgacgtcatggcggccggatgcgccgggcttcatcgacaccacggaggaagagaagagggcagataccccaccccacaggtttcgttccgagaactggctgccctgtcctgcagcaggcttggcccaggtggggtgacatgggtgctggtggatgtggtaggtgatgtccatctggccactatgacaagcccctagctctgaagacctggcccttcttgggttgtggagaggacccaggtttgaagctctgagagtgccaggcaggctccacagatactgggacccctggggtcttcaaatagtataacaccaggacctcagaatcatagaacagcatttcttagatttaaaggatcctagaatctcaaaaccacagactgtggggtctacggtcccaaagtctcagtatgtgtaggccagtgtccctggtgtccaaactccttggaaccatctgaaagtcaggcagcttgctgcttcatagggcctcttgcctaccaggcctggaaacagagccagcctccctagggcctcagtctccctgtccactctggaacaacgttcccaaatacatggccactccgccagagatggcaacagggggaggaggaggttgaggctggtgtgcctttggtctgggcctcatggggggagctggaaaagcctcagccttcgccaatacagagcccatcatcagactctctagaggggccccacaatcaaggttttcggggaccagcaccagctctggggacacacagcctgactgactgacatgcctccatcatcaccacgctctggccaactaggcctcctgacctatggagtccggggcctcacctagcccagctcttgtgaggctgggccccacactgtgatcgtggatcgtccaacctgtgggaagttggggtccaacgtgtgagaaggcagaagggggaatggtagcccaggttccccttcccccttctgggtgctgaggggtaaactgaggccttcagttggggagagagccagaaccagggtcccacctagagtcctgagatctaggcttggatttcaactctgccgctgcatttcggtgaggccctgagatctctggtcttcaatttgcccttctacactgagcacggagaggcgtggagtagacaagggccagggcccttctacgctgtctggttaagtcattaggtgtctgcagggcttcaagttgacaattgcccctctatccaggggactggctgagagatagggatacatagagacaaagagacacacacaaagagcgagcaagagagaacaagagatagtgagagacattgagagaaatggacacatgcatggagagccagagtgcatgtgtgcgagaggaggattgcctcaaataagaacatttgctggtctctggctggttcaactgatgctgcctgaaataatcaagaataaagaagggcaaggtgccagggacacccatggctgggtattgaattgtattgcaaagcaacaatcagcaaaacagtgtggccctggtataagaacagatactggggaagagaacagaatagaaagcttggacatggacccacatatggagagaactgaatttgtgatgaatgtggcatttcaaactggaggaccatggagtatggtttaacaaatgtgtctgagataattagggagaagataaagttattgagtgaatagtcagtccattatcccaacaacccctccctgcccagtttgaaatgtcaccatcatcatataccctaaaatgcccagatccattcaagatataagttttaacacctaatgctgatcttgggtttattgtgtgtcaggccttgtgctaagtatttactgtggttaaaaattttaatctaaacaaagactcctgaggaaggtactattataaccattgcagtacatatgaggaaatggaggtatggagaggttaagtgcctggctaaaaatcacacatagggcttggggtgacgctgggtttgtcccagacagtctggctccagtacccacactcttaacctctatagtaaatggaaaaaatgaagccataaaagagactagaagccaacataggtgaacatttatctcattttcaagtaggaaaggactttctaagcacaaaaccagagacagaagccacagaaaaaaagactaacctatttgactgtataaaaccatcataagcatcacaaaaaacaccataaacaaatagaaaaaaagcaaatgatgaattggggaaaatatttgctatatatgtaatggctgatgaaaggttaataaccattccaaataaagagctgtggcaaatcaataagggaaaaataagatgaacaccctattaggagtaaggacatgaccagacaaccaaaaaaaaaaaaaaaaaaaagcatgaatggccaatgaatagtaaaagtaatcacaagatgcaaatttcaacaatgtgataatgtgtttttcttacctgtcatgttgggaaataattaaaacataataatactcacctagggttagcttaagtagagggagcataaaataggacaaccttttggaaggagaattagcagagagggtcataaactttaaaaatgcacgccccctttgccccagcaactcccttttcaggaatccaaggaagcagtcagggatgtttatagaaaaaaacgagaaacaaccggaatgtccaacaatcggcacttggtcaaatcaatcaaagttcatgctgatgtgaggacagtcttgtccatcatgaaagatcatgtgttcaaacaatttttagtaagcttcaaaaacactactgttaattgaataaagcaggaacaaaaccaatatatagcatgattctaatttggttacagaaatactaatagctaacacttcgtgagcacttactttgtgccaaacgctgtgctaagcctgcagaatcgagctcaccccagccctgaacaacctgtttgcttcctgaatatggactctggtcacacacatgcagtcctggggtaggtccacacagctaaactacggttgacaatggtgtgaagtgctccctgcccccccgccccaagggtctcctctaaagcgatacaagcaaagttcagttaagtgctcagcttgccccggcaccttgcaatcctcctgctactagggtgaacagaactgatgctcactctcataaaatgtaaaggtcctcggcgacattactattattaaacgccagctgtgtacaaagctctaggctggatgctggctgggaaggcaggtgggggaaggcaagaaaagagagcgggagagatggaggaaaggagatcgatggagtgtggtcaagatggaggagacagagataggggagatggtcagaggccaggagagatgcggggaaagagagtctgagtgtagcgacagacagatggcgggagaaagagaggcagagaaacatgtaaaagagcaagacagggtgagcagagagacagagaaggatgagaggcatcaagagctaagagacaaagagatgagagagatgcagttgaaattttcagttgcacctggacagcatttcaagttgttcaaagctctgaaatccataaagactggcagctgacatattttaaaaatcctatccatctacgtatcaattgatgaattcatttatttttgcccctgcccatgcattaagtacttcacctttaagtcttctgccatttattctattattatttttttaaagaccttacctggctggaatcacggtagctgggtacatcccactgtaccagagggcccctgacccccccgccgtgcctacctccctgccatctcctccaatggggcccacatctggtaggggagagcagggacactcaccttggtgaagtggactgacagaaaaggatcagcctggcttgtgggaaactgtcacgtatcaaaaacaactttgcttttataccgagaagaaaaaccacgctgtacggtgtggaagccgcagacctctctcttctaataatccaaatttttttcgatgagtgtgtgc

SEQ ID NO: 1720 - DNA, 14392 bp, Homo sapiens; identical to SEQ ID NO: 1719
  source 1..14392: mol_type = genomic DNA

SEQ ID NO: 1721 - DNA, 6128 bp, Homo sapiens
  source 1..6128: mol_type = genomic DNA
taataaactcatatctgtttattctccccaaatcaggggacacaaaggcttttttttttttttctgatgagtgggtaatcctaaaataagcaggaaatgcctgtggctcagcctaactcaaggtgagacgaagctggagctgggagctcgaaagtgtcccccagctccctcctcactttgcctgtaactccacctctgcagaaggtaaagtagaattggtagctgtgtcactggtttgggttgagtcctcggtcagggccctctccagactggcgggaagggcgtggatcagcctctcccggaagtcctggcccatgaagacatagagcatggggttgaggcagctgttgaagaaggccagggcacttgtcacatccactgcaataccaatttctttgtacatgccttgcaataactcacggattctgactgtggctataagggccaccacctgatatggggaccagcagagaaaaaaggctgctgcgacaaaggagaggacccgtaagggacgactggacttaatcaagccttgcttgtggatcttggtggcaataagcccataactgacagcaacgatggacatgggtgcgctgaagccaatgatgaaccggatgatgcctctcaccgtcaacatggcaacggccacatttatcctctctttagggtcgttggtccagggcgaaaagttaaaagtgcaggctactgtccccgttttaccaggtactgtagtcacacgaatgataactggcaatgtgaggagcagagccatcacccagggcccaatgatcaccttcttggccaggctcacggtgcggtggttctgggtccagactggatgcaggacgcaaacacagcggtccagagcaatgagggcgatcaggaagacacttccgaacaagttgatgtccactatggtaaagacgaatttgcacaggaaccagccgaaaggccaatgtcctcccatggccttcctgaccatgaagaatggcaaagtggaggtgaaacagaagtcagccacggccaggttcaggtaactgatggtggtgactgtgtgtgtcatccggaatccagccacccagatcacaagcccgttgcccaggaccccgaggacaaaggtgactgcaaataccagataagtgatgatatccaggaagagatagccagcagatacagcaggtgtccctccagagatgttcgtggggagagaggaatttgtctccatcttgtctgctcctgaaatagtgcagtcgtggtcattcctcagttatgaacctccgtaccatttccccaccccctcatttctgcccctgccagttttcccactcctagctttctcaccttcccctagagctcccacaacagccggaacatcctcaccactgtcccttacacatgcccacatctatacattggcaatcttttattgtacctgttgggcaagattacatctttttttttttttttgagatggaatattgctctgtcacccaggctggagtgcagtggcgtgatctctcactgcaacctccacctcccgggttcaagcaattcccctgcctcagcgtcctgagtagctgagactacaggtatgcaccaccccactcctggctaattttcgtatatttagtagaggtggggttttgccatgttggccaggctggtcttgaactgctgaccccaggtgatccacccacctcagcctcccaaagtgctgggattacagacgtgagctaccacgtgtggccaagattgcatcttatgacacatcctcataattgctaacatgcaagcccctaccagggagattaaatggctaaggaagatagggtccttgacctccaagaggagaatatggggccaaagatgtatagagaaaacatgtattcaaacaaaaatgttcatagagacactcctccctatagccaaaaggtagaaacaacccagatgtccatcaacagatgaatggataaacaaaatgtggtttatccacccaatggaatattattctgccataaaaaacaatgaagcactgatatatgctacaacgtggctgaaccttgaaaacattactctaaacaaaagagggctggatgtggtggttcacgcctgtcatctcagagctttgggaagccgaggtaggagggttgcttgagctcaggagttcatgatcagcctgagccacatagcaagatcctcatctctaacaacaacaacaacaaaattaaattaaattagctggatgtggtggcacacacctgtagtcctagctactcagaagggtgagatgggaggctcacttgagcccaggaattcaaggttaatagtgtactatgattgagccactgcactccagcctgggcaacaaagcaagaccctgtctctaaaatgaaagaaaaaagaaaggaaggaaagaaggaggaaggaaggagagaaggaaggaagacaccacaagtcacattttgtatgattccacttgtatgaaatatccagagtagccaaactcacagagaccgaatgcagattagtgattgccagggactggggaaactaggaagtggggaattgttgcttaatgaatatgcagtttttgcttggtgtgattaaaaagttctggaactagataatggttatggttgcaacacactgtagatgtacttaatgccattgaattgtacatttaaatgggtaacttttttattgttgtttgagacgcagtctcgttctgtcacccaggctggagtgcagtggtgcgatcttggctcactgcaacctccgcctcccgcgtttaagtgattctcctgcctcagcctcctgagtagctggaattacaggcacttgccaccatgcccagctaatttttatatttttgtagagatggggtttcaccatgttggccagcctggtctcaaactccttgacctcaggtgatctgcccgcctcggcgtcccaaagtgctgagattataggcgtgagccactgtgcccagcctaaaatggttaactttttgtattttaccatcaatttaataaaggaaaaataagagcataagatatcagaaaatcagtgggcgacagcttcagtgacctagtgtcacacaaacgtggactaagactttctctcacccataacactgcataagaactataaggtatgcaacttctcagccaggcgcagtggctcacgcctgtaatcccagtaccttgggaggccgaggcgggtggatcatgaggttagcagttcgagaccagcctggccaacatggagaagccccatctctactaaaaatacaaaaattagccaggcatggcggtgggtgcttttagtcccagctactccagaggctgaggcaggagaatcacttgaacgtgggaggcggaggttgcagtgagcagagactgcgccattgcactccagcctgggcgacagagcgagactccgtttcaaaaaaaaaaaaaagatatgcaacttctccactccaaattctgctcgctctctctctttaaggtcatgaaatctccctttcctctctcatcgtgggaagcaaggcatagtacttggttagttttccaacataggtcaaatggatccgtgagtgatactaaacgacgtataatcaagtattatatccaatggattctgtgctagaagaagtcagaacaacagactctgtttccactctcgtctctgcggttaccttggccagatggatgggaggtgcttctccatccattggatgggctcagcactcttggggatgtagaagaccgtgatagaaataatagtccaaatatgtattggatatgacatttcattagatcaggtatgcaaagtgcatgtcaggttcttgctgagagctggccttctctcttttttttaatttattttattttatttatttatttattttgagatggagtctctctctatcacccaggctggagtgcagtggcgtgatctgagctcactgcaacctccgcctcccaggttcaagcaattctcctgtctcagcctcctgagtagctgggatttcaggtgcacgccgccgtgcctggctaatttttctttttaattgtattttagtagacatggggtttcaccatgttgcccaggctggtctcaaactcttgagctcaggcagtccacctgcctcagcctcccaaagtgctaggattacaggtgtgagccactgcgcccggcctggtcttctcttctaatgcttgcagcagccttcctcaaaattgttactatgagggtcactgtctttatggtacccattttgcagacgaggaaagtgcgacttagagcatttcagttaattccttaaagtcacccaacagcccaggctgtcgaattccagcaaaagtctctttctgcctctgccctgccacgctactggcacagaagagctgtctaatgcactagtcactcaccacatgtggttttcaagcacttgaattgtggctagtccaactggagacaggctgtaggagtaaaatacccatcagatttcaaagacttagtatgaaaaaaatattgtgaccatctcattaatagtttttatattgactacatgttaaaatgataataatttggctatttaagtttaggttagatattttattaaaattaagttcgcatgtttctcttcacctttttaaagtgcctacttgacactttgaaattacatatgtgtctcacatttctaatgaactttgatactctacaatctcagaaacaactcagagatgtctccctcccctaccacccatccaaccaccaaaataccctgaggactctttgtcctcaagaatctctaaggcaaccagttcagaagattgttgcaatgaatgatgaggattctgcaataatgagctggaacataccagagaggaaaacctgtgcaattttgtccaattatggttcaagggaaaaatcctgtgatttgcaatgaacacaggccttggtggctgccatcgatgaaggactttatgcttgataatcattgtaccacatcctcaactttcttgcctctgatctcaacaaactcagcattgattatacatcatcatccctgtgtgacggaagaggaaactaggagcttgatgagaaatgacagccaatgtctgcagattcatgagagggcagggctgtattccgctactgggtcctatgcaccatgcagaaccagtgtcttcacgtggagactcatcactgatccgaaaggtgactgcttctgtattacactcatttccccatgacccatcataaagtcgttagggctcttttgctttctcctgaaagcttcaaaccaaacatcctttcccatcccgactcaagccctcaagctgatgcccttgcctcttgctccaccagattctcctcctgctggctcctgcatcactgttctctgccctcatctctgtaaccagaaaacaagtgtttccatccaagaattaccctctactggtcccataaaactcattcccccatttactcaagaacttccctccttcacttatcccttctctctcctgcagcctcatagtgtctctatattccatcattcccatcaggaccccaataaagtctagagcctatttgtttatttatttatttacttatttatttgagatggagtctcactctgtcacctaggctggagtacagtggtgcaatctgagctcactgcaacctccacctcccagattcaagcaattctcctgcctcagcctcccaagtagcttgaattacagacgcccaccaccacgcctggctaatttttgtatttttaatagaagtgaggtttcaacatgttggccaggctggtctcgaactcctgacctcaagttatccacctgccttggcctcccaaagtgctgggattacaagcatgagtcaccgtgcccggcctgtttagaacctctttaaaaaaattattcttcaactccacatccttcttcaaacaaagagtctattgtgttcaccagtgtattaagtgtgtctatgtcaagctacccagtcccccagaatatgtttcttacctggactgttcaccagctgtggtcttgctctgggtagttctaggtctgggtctcctggggagagtgactcaggctctaatgatt

SEQ ID NO: 1722 - DNA, 6125 bp, Homo sapiens
  source 1..6125: mol_type = genomic DNA
taaactcatatctgtttattctccccaaatcaggggacacaaaggcttttttttttttttctgatgagtgggtaatcctaaaataagcaggaaatgcctgtggctcagcctaactcaaggtgagacgaagctggagctgggagctcgaaagtgtcccccagctccctcctcactttgcctgtaactccacctctgcagaaggtaaagtagaattggtagctgtgtcactggtttgggttgagtcctcggtcagggccctctccagactggcgggaagggcgtggatcagcctctcccggaagtcctggcccatgaagacatagagcatggggttgaggcagctgttgaagaaggccagggcacttgtcacatccactgcaataccaatttctttgtacatgccttgcaataactcacggattctgactgtggctataagggccaccacctgatatggggaccagcagagaaaaaaggctgctgcgacaaaggagaggacccgtaagggacgactggacttaatcaagccttgcttgtggatcttggtggcaataagcccataactgacagcaacgatggacatgggtgcgctgaagccaatgatgaaccggatgatgcctctcaccgtcaacatggcaacggccacatttatcctctctttagggtcgttggtccagggcgaaaagttaaaagtgcaggctactgtccccgttttaccaggtactgtagtcacacgaatgataactggcaatgtgaggagcagagccatcacccagggcccaatgatcaccttcttggccaggctcacggtgcggtggttctgggtccagactggatgcaggacgcaaacacagcggtccagagcaatgagggcgatcaggaagacacttccgaacaagttgatgtccactatggtaaagacgaatttgcacaggaaccagccgaaaggccaatgtcctcccatggccttcctgaccatgaagaatggcaaagtggaggtgaaacagaagtcagccacggccaggttcaggtaactgatggtggtgactgtgtgtgtcatccggaatccagccacccagatcacaagcccgttgcccaggaccccgaggacaaaggtgactgcaaataccagataagtgatgatatccaggaagagatagccagcagatacagcaggtgtccctccagagatgttcgtggggagagaggaatttgtctccatcttgtctgctcctgaaatagtgcagtcgtggtcattcctcagttatgaacctccgtaccatttccccaccccctcatttctgcccctgccagttttcccactcctagctttctcaccttcccctagagctcccacaacagccggaacatcctcaccactgtcccttacacatgcccacatctatacattggcaatcttttattgtacctgttgggcaagattacatctttttttttttttttgagatggaatattgctctgtcacccaggctggagtgcagtggcgtgatctctcactgcaacctccacctcccgggttcaagcaattcccctgcctcagcgtcctgagtagctgagactacaggtatgcaccaccccactcctggctaattttcgtatatttagtagaggtggggttttgccatgttggccaggctggtcttgaactgctgaccccaggtgatccacccacctcagcctcccaaagtgctgggattacagacgtgagctaccacgtgtggccaagattgcatcttatgacacatcctcataattgctaacatgcaagcccctaccagggagattaaatggctaaggaagatagggtccttgacctccaagaggagaatatggggccaaagatgtatagagaaaacatgtattcaaacaaaaatgttcatagagacactcctccctatagccaaaaggtagaaacaacccagatgtccatcaacagatgaatggataaacaaaatgtggtttatccacccaatggaatattattctgccataaaaaacaatgaagcactgatatatgctacaacgtggctgaaccttgaaaacattactctaaacaaaagagggctggatgtggtggttcacgcctgtcatctcagagctttgggaagccgaggtaggagggttgcttgagctcaggagttcatgatcagcctgagccacatagcaagatcctcatctctaacaacaacaacaacaaaattaaattaaattagctggatgtggtggcacacacctgtagtcctagctactcagaagggtgagatgggaggctcacttgagcccaggaattcaaggttaatagtgtactatgattgagccactgcactccagcctgggcaacaaagcaagaccctgtctctaaaatgaaagaaaaaagaaaggaaggaaagaaggaggaaggaaggagagaaggaaggaagacaccacaagtcacattttgtatgattccacttgtatgaaatatccagagtagccaaactcacagagaccgaatgcagattagtgattgccagggactggggaaactaggaagtggggaattgttgcttaatgaatatgcagtttttgcttggtgtgattaaaaagttctggaactagataatggttatggttgcaacacactgtagatgtacttaatgccattgaattgtacatttaaatgggtaacttttttattgttgtttgagacgcagtctcgttctgtcacccaggctggagtgcagtggtgcgatcttggctcactgcaacctccgcctcccgcgtttaagtgattctcctgcctcagcctcctgagtagctggaattacaggcacttgccaccatgcccagctaatttttatatttttgtagagatggggtttcaccatgttggccagcctggtctcaaactccttgacctcaggtgatctgcccgcctcggcgtcccaaagtgctgagattataggcgtgagccactgtgcccagcctaaaatggttaactttttgtattttaccatcaatttaataaaggaaaaataagagcataagatatcagaaaatcagtgggcgacagcttcagtgacctagtgtcacacaaacgtggactaagactttctctcacccataacactgcataagaactataaggtatgcaacttctcagccaggcgcagtggctcacgcctgtaatcccagtaccttgggaggccgaggcgggtggatcatgaggttagcagttcgagaccagcctggccaacatggagaagccccatctctactaaaaatacaaaaattagccaggcatggcggtgggtgcttttagtcccagctactccagaggctgaggcaggagaatcacttgaacgtgggaggcggaggttgcagtgagcagagactgcgccattgcactccagcctgggcgacagagcgagactccgtttcaaaaaaaaaaaaaagatatgcaacttctccactccaaattctgctcgctctctctctttaaggtcatgaaatctccctttcctctctcatcgtgggaagcaaggcatagtacttggttagttttccaacataggtcaaatggatccgtgagtgatactaaacgacgtataatcaagtattatatccaatggattctgtgctagaagaagtcagaacaacagactctgtttccactctcgtctctgcggttaccttggccagatggatgggaggtgcttctccatccattggatgggctcagcactcttggggatgtagaagaccgtgatagaaataatagtccaaatatgtattggatatgacatttcattagatcaggtatgcaaagtgcatgtcaggttcttgctgagagctggccttctctcttttttttaatttattttattttatttatttatttattttgagatggagtctctctctatcacccaggctggagtgcagtggcgtgatctgagctcactgcaacctccgcctcccaggttcaagcaattctcctgtctcagcctcctgagtagctgggatttcaggtgcacgccgccgtgcctggctaatttttctttttaattgtattttagtagacatggggtttcaccatgttgcccaggctggtctcaaactcttgagctcaggcagtccacctgcctcagcctcccaaagtgctaggattacaggtgtgagccactgcgcccggcctggtcttctcttctaatgcttgcagcagccttcctcaaaattgttactatgagggtcactgtctttatggtacccattttgcagacgaggaaagtgcgacttagagcatttcagttaattccttaaagtcacccaacagcccaggctgtcgaattccagcaaaagtctctttctgcctctgccctgccacgctactggcacagaagagctgtctaatgcactagtcactcaccacatgtggttttcaagcacttgaattgtggctagtccaactggagacaggctgtaggagtaaaatacccatcagatttcaaagacttagtatgaaaaaaatattgtgaccatctcattaatagtttttatattgactacatgttaaaatgataataatttggctatttaagtttaggttagatattttattaaaattaagttcgcatgtttctcttcacctttttaaagtgcctacttgacactttgaaattacatatgtgtctcacatttctaatgaactttgatactctacaatctcagaaacaactcagagatgtctccctcccctaccacccatccaaccaccaaaataccctgaggactctttgtcctcaagaatctctaaggcaaccagttcagaagattgttgcaatgaatgatgaggattctgcaataatgagctggaacataccagagaggaaaacctgtgcaattttgtccaattatggttcaagggaaaaatcctgtgatttgcaatgaacacaggccttggtggctgccatcgatgaaggactttatgcttgataatcattgtaccacatcctcaactttcttgcctctgatctcaacaaactcagcattgattatacatcatcatccctgtgtgacggaagaggaaactaggagcttgatgagaaatgacagccaatgtctgcagattcatgagagggcagggctgtattccgctactgggtcctatgcaccatgcagaaccagtgtcttcacgtggagactcatcactgatccgaaaggtgactgcttctgtattacactcatttccccatgacccatcataaagtcgttagggctcttttgctttctcctgaaagcttcaaaccaaacatcctttcccatcccgactcaagccctcaagctgatgcccttgcctcttgctccaccagattctcctcctgctggctcctgcatcactgttctctgccctcatctctgtaaccagaaaacaagtgtttccatccaagaattaccctctactggtcccataaaactcattcccccatttactcaagaacttccctccttcacttatcccttctctctcctgcagcctcatagtgtctctatattccatcattcccatcaggaccccaataaagtctagagcctatttgtttatttatttatttacttatttatttgagatggagtctcactctgtcacctaggctggagtacagtggtgcaatctgagctcactgcaacctccacctcccagattcaagcaattctcctgcctcagcctcccaagtagcttgaattacagacgcccaccaccacgcctggctaatttttgtatttttaatagaagtgaggtttcaacatgttggccaggctggtctcgaactcctgacctcaagttatccacctgccttggcctcccaaagtgctgggattacaagcatgagtcaccgtgcccggcctgtttagaacctctttaaaaaaattattcttcaactccacatccttcttcaaacaaagagtctattgtgttcaccagtgtattaagtgtgtctatgtcaagctacccagtcccccagaatatgtttcttacctggactgttcaccagctgtggtcttgctctgggtagttctaggtctgggtctcctggggagagtgactcaggctctaatgatt

SEQ ID NO: 1723 - DNA, 5615 bp, Homo sapiens
  source 1..5615: mol_type = genomic DNA
tgcccagtagggaggaaaaccggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtgtaagccctggtctctttcagcaactgtctcaagggccttcccacccctactctgtagtccctgattttttttccccttgagcatctttgtgcagcttggactcaaacctcagagtccaaccatcctactcattagaccagtgttcttcaaactggtctgatggaaaaatcacctaaggggcgtgtctaaaatgtaaatatcccatcctcatctcacacttactaatttagaaactccaaggggttgggaatttattttttattttttatttttggtttatgggaattcatattttaacaaatatggtgatttaagtagtggagagtcctacctctcaactcactttttcattcatgtattcattcatttgctataatttttcagaagcatgctttgtgctgggcatcacggtagctgctaaggacagagacaccttgcagattaaggtgtggtccctggaccatgcccaacggcataggcagcacttgaaaactggctaaaaacgcagactctcaggccccgggccagagctactgaatcaaaatctgcattttaacaaggttcccaggtgattccctgtgcgtatgcagtaaagtttgggctaaagcactgctttccagggaacactttctcttctttctctttcattcaccagtagactcttcacactgagacttagaagccaggaatcccagggacatgggtggaggccctgtggcccctggggctgggcatgcagccacacctcccttcacctcagcctctgttgccagatcctcagcctgggggaaggaagggaggctcataggaggtatttcaatgagctggaatgacttgctgaaaaacaacatagagttcccctcccttccactcttttccacgagggcctcatccttatgtaaagggaaccacagtgatctgttcacttctttcttgcctaattgccctttgctttgtgctctcctctctcaaagtctgtataagcctccccctctattccttgtcccccaaagatcacaatctccttcagacactattaatgtcccccaagtggcaaagtccctattcattttcattttctcttttttttttttttttttttttgagacggagtctcgctcagttgcccaggctggagtgcagtggtgcaatcttggctcactgcaaactccgtctcccggcttcatgccattctcctgcctcagcctcccaagtagctgggatcacaggcgtgtgccaccacactcggctaatttttgtatttttagtagagaaggggtttcgccttgttggccaggctggtctcaaactcctgacctcaggtgatccgcccgcttcagcctcccaaagtgctgggattataggcgtgagcaacctggcattctttttttttttttttttattctttttgagatggagtcttgctctgttgcccaggctggcgtgcaatggcatgatcttggctcactgaaacctctttgtctctcaggttcaagagattcttctgcctcagcctccccagtagctgtgattatcggcacccaccaccacgcccggctaattttttatttctagtagagacagggtttcaccttgttggtcaggctggtctcaaactcctggcctcaagtgatccaccctcctctgcctcccaaagtgctgggattacaggcgtgagccaccgcgcctggcaccgccgttcattttctgtgtgagcacttgttgtatatatactaggctcagttttcagaggggagaggcaagtgccttctgtatatccctccccagcacgtggcttcctgccagcatctcttttgctatcccatcttttctctttctggccacagcagcctcttcattgtgtggttcccagggcccagccaagcacttgctagaccagaggattttgacatttttttgtcctccttattctttctcagccttctctgtccatttcccacccccattttcagacctgagaggctcacctaaataatttaggtgtggataattcaggctgtaactggggacatggaggcaggggtagcaggagggttagtgagggcctggaggagagagctgggtcctggactctctgtggatgataagagctggccttgcagtgagagggggtagagtgggacggctgagtatctcagagcacacacacggcttaccacaatctcttgcctctgtatcagttttattttttattttattcactttttctttttttgagacaggatctcactccatcaccaggctggagtacaatggcacaatcacagctcactgcagcctcaacctcctgggctcaagtgatccttcccacttcagcctctggagtagcagggactacaggcacaccccaagatgcctggctaatttttgtattttttgtagagatggggttttgtcatgttgcccaggctattctcgaactcctgggctcaagtgatctgcccgcccagcctcccaagtagctgagactataggtgtgcaccaccacttccagctaattttttgtttttgttgaatctgggtcttgctatgttgcccaggctggtcatgaactcctggcttcaagtgatcctccagctaaggcctcccaaagtactgggattacagtcatgagccactgtacctggccccagactagtttttaaaaatagtgtttccacaggctgagggttaggaaaaaaaaaagaaaagaaatagtgtgctttctttctcctgttctaaggtagaaaaccatggcaaggtatccatggataccttgagagcagtggacagaatcgtagtccctttttgacttcacccctcaggccctccagagtactctgtgtcctgcccgccttgtaccccccctggctgtgtgtgcatgtggaaagtcatcttgcatctgttctcttccaggtttctttttggagacaggcccttttggtgggtccatgagtctggttactacagccaggctccagcccaggttcaccagttcccctcttcttgtgagactggtccaggtgggaagcctcaaacattctccctttcccaatgtggttagggttcgggtgaacatttcagagtacttttcagcctgggtggcccaaccaaaggaccagcctctcaattactggcgcagagaacaaaagaaccccagggagaccaagctgagttatgggaggagggcactcatgctatgtaccagctgcccaccttgtatagaggacagccaagagacacagatcaggacagaaacctgagcacagtgacctcaagtggcagtaaaaaggcctcagagcagagcgagttatgaatcagtgctggggaaaagctcttctcagccaggaaaggcagctgtattattgaggcatcaccaggggccccggggttctgcctccatcttctcaccacgagcttctggatttgctggcaggcagcccttctggacactgcatgatcacaggagcagccctctggcccataatgacggccctgtcttcgcaggtggccactcgggcccgcaggtatacccttggcattgcccaccattgggagcaggggtgatggcaccctgtacctaatagacacagcagcatggcagcctgggagctggagttttggggaccctaggttgtgtggttcaaccatggagtacctgggtgctgcaggaggccaagctgtgtatggacacgctctgagctccttgcctctcttctttctagccgctgggtaagggtgatgcctagcctggcttattgcaccttccttttggcggttggcttgtcgcgaatcttcatcttagcacatttccctcaccaggtgctggctggcctaataactggtgagcaactggggcaacggggtggactgagaggatgcctttggcagtgggaggatcagtctaggatcttcccatcgctcccagcttctgtagagcccaccccagaggccccccgttatgtctcagtttattctcttgccaagctgcactgcagctgggggtcggggtggggagggtcatatccccagactccttgaagctgttgtcactccactctcctaggcgctgtcctgggctggctgatgactccccgagtgcctatggagcgggagctaagcttctatgggttgactgcactggccctcatgctaggcaccagcctcatctattggaccctctttacactgggcctggatctttcttggtaagtctcgctttgaagcctgggcaggctgggccctgtcctatctcgcctgcacctagcctggtgtgtctctggttcattatagctaaaaaaggacacattacctattcacatagaccctcacaggcacaaaacagaacatgggagtgggccccaagggcagatggccaagagccagtggccttctatgttccagcctctcctggcaagaactcttcttccccacaggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 1724 - DNA, 5615 bp, Homo sapiens; identical to SEQ ID NO: 1723
  source 1..5615: mol_type = genomic DNA

SEQ ID NO: 1725 - DNA, 5615 bp, Homo sapiens; identical to SEQ ID NO: 1723
  source 1..5615: mol_type = genomic DNA

SEQ ID NO: 1726 - DNA, 9109 bp, Homo sapiens
  source 1..9109: mol_type = genomic DNA
gggcattcacaaaaagtattttattattcttaacagtactcactttaaaggaataagaggatagcatacattttttacagacaatatataaatgttgtacataattaacaataacttagttcactaatccaaaataaaacaagccaaataaaacataaaaacagaaaatactgccgattctttttcttatgcggacactagtacaaaataagttacttctggccgtggtgctccctgcagcgactgcccgcccatattgcacttggtcactacatcagcacaatcctcctcctgggccaggggcccctcacaggccaccacaccccgccgtcaccgcatacagaatctaagctcgggacacgtttatatacagctgtaccttgggaaggatccagacagccacagtaaagctggacctgagaccccagcagggacacagcctctccctgggtcctggtcctgacctgcccccaactcctgccttcaccccctgccaggccagcaaatgccaaccagcccccagaaaccaagggcagcaaaggcccctccccacccccagctttcatactagggctgtgggatcccagctcttttccaaaaagaattgcaaagctccaaccttgtgtgtaggttttattcctttcatagcagggctcctgtggctacgtacaatcaactggacccaaaaagagtttaaaaataaaacaattaactcatcagcgagttaagcctatgcatttttttaatattttttcttttgtctcagagtaggaggcgagggggttgaagggttagcagaaaaaggatgtatttacagggtccacctgacaagacaggctgtggcttgcgctcagtaaggggacacagtcacagcagcttcggcctcaaagccaagggagcgatctgggagacgtttcccctttcaagaaaatgttgtttccttcctgtgacccagccctggcctgggaatctgtgcaggaccgcccgtgattgtctctgccctccagggcctggcccgtcaaagcaggcaccagctcaccctccctgggccgtggccactctggctttggctcagcccagcctggagttcggctatttcagagagggaagccagaggagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcggtcaggtgcggaggcagcctctcagcggtggggaacattcacagtaactgctggcaggctgctgggcgccctccaggagagggggtgctgggccgagccgggctggcaggagtggtgtcggccttcgggaaatgctgggctgctaagggtttggtccacccatcccgggagtgcccggtcctcgacgtccatctgttccctagcccatggcggtcaccatgctggacgggtgggggtggccgaaggagaggctggaggaggggtggatgggcgtcggagtgggcaggatgtgtccggagtggctgaagggcgggaggtggcccacaggtgccatgtgtccagccagggcagctgcactgaagggggatgacttctcctgcatgcactttgacagctcctcgaagcactccgcccctttcttgctcttcttggacttgttggacatcttccggttccgagtctggatcccttccttcttcatggtcagtggcctgttaacctagaggcaaccaccagttttcagagggccagttccttcctccagcaacattcctcccaccccgccacagcgtggaccagaggcaggtcaagctgagggtcccaggaagccaggaattgtgcccgaccttcatagtcccatcaccagatggctaccattccaggaagggcgggttctggcatatggggctgacccacaccctccctggctctgcccaccgcatgccagcactgcccagccaactgaagtcctcccccccaccctgaccctttttaagcagagaaaccacttccctagtccgagaccctgtcctagccagctccacctcctgagcagaggcaaggcacccctcttacgggaagcccttctggcgctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcgtcagcaggctggactcccacgcccacctcgacccccctccctgaccctcgctccacccccagtccccaccagctcagtcaaggagggctaaatctcacatgggaatcaaagcatctcagaaccatggaattttagaatttgagaacgaaataagtcaagactcacagaactttggaataaagaactctcagaagcctgatgttagaatcaacgggattgcaagagctacagaggagaattagctacctcccccaactaccctgcgctctaactccataaatggggaaactgaggccctgagaagggctctctagtagcacaggcatcctgaggctgagccggcttggtccccctcgagcccctggatctggggccgattctgtgtctcctctagcacgactccgctcaaaatccataatcctgggtgagtcagtgtcgctgaggccagcgcaggtttacagagtgcagagctgcaccgtccaacactgtagcagctggccacaggcagccatttaaataagatctaactacaaattaacaaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccgcagcccctctgagtcctagtccctcaggaaatgcctggcagaggtagggtctggaaatgagcgcctggtccttgcagagagaagctagagggaggctttacccaagaaaacagatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagccgcgggggcagggaggggtgagtaagcagcctgaagctggaattctgactcaggggccaacgccgcgtcctccacctctacccccacccgggcctcaccccgccctcgctccaggggaaaaaaaggcccccaaagcagggaacgatttaagcctcataaatcacttcgccctgaaaaaatatatttattattcttagcattttacgcattatttgcagagtggagggtattagaaatttcaaaacagcccagcgagaggcaggactgagctgaggagactctaaaaactcgcagagtccggaaacagatacacgaagtttccttatcttcaggctgcagatgtccggataggaaactccggcaggagatccgaaagggcatttttttaaaatcactcaaatgaaaatacacagtataggtgactccatggaaaaataataaagggcaggtttttttagtggccggtgtgagtttgtgttttatttaaataagcacgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtcttcgcttgggcttgatgagtggtcggttctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggacgagagggtctcccacatgggagggggcacaggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgccccaccccgtctttctgctctaagtccagaagcatttccctctttctccccaacttttctcctcttccaccaaagctctagaatttttctgagtcctggaaataatggatcgaagttgttgttctttaaaataaaataaataataagctctttcttttttagataagtggcctgggttttttttgtttgtattttttttttcaattaaaagaccatctggaattcaaataaaatgcaaaacaaacaggagaaaggaccaagaaaaggcaagctgacgggtctgagcagaactaggaccctgagccggggctcagcgggtgctggggccagcgggggctggggctggggaccaagttgagcaggatcactggctggcatcgtgttccccaggaagttattcttgatttagtttaaactaaatgaggagtacagcctggcaagagaaggtggttcctgcactcaggagtaactgttttaaaaaccttccccctctgtggctcaaagggattcgggaaagagacatggacagcaagaactccacactagccacgagtttctgggtttatgctctgtggccagattcttggacaaacccagtttggccccagccagctgcgggaaaaggggcgggggcactgcagcttcatcccctcactccagccctcagggagggagagggaagggcctggcgagggcagggagcaggagcaggtcctgggaattttgctctggggaaaatctcccgaggagatcagggagccatcgaaatcccaagatcagactgattgagttagagacccagattccttaatggtctggaacctccggagtgcctgaaacatgcacacacaacatgcacacagacacacgtatacacatgcacacacgctcccaaacacatgcacatacagagtcacttccctcgcttcacatactaagtcctgaggtggcttgaattttcacttaagattcagggagggaaagggggaattcctgttctatgttctggtcaggcagtgaccaaccctggggcaaggaactgaactttgggggtacactggaagcacttaagaaaatggcaaaagttttagagtctcctctccctgacccgggggtctcaaacatctgctgggggctattagagcgagacatcacccatccccagatctgggaaaccaacactgccacctctcccaagtcacagctccccaccacaaaaacgcaaatgctcccctcttccacgaagtccccagcacctgcctttacctgaacaggaacgagccttgctgcgctgcttaggggtgaagctggaggccggtccccccaggaagcctccggggtggaagagtccgctgctgtagtcgtgggcagccgccggcacataggaggggtaggtggggatggggtggtgtgtagcaggctgggtgcccatagtagctaggcctgggcgcaggggactgccactttccatcttcatgctctccgtcagtgacacctggtacttgacgccgtccttgtcctctcctcgggctgcactaccccccgcggaagatgaggctggagacgcagcccccgtggtgctagggtcaggagacacttctttgggtggcgtgggtgggaagccgaaaaggtgggagccagagtgggctgctgtaggggtgagggaggccactgagctcccgctgcctcccccgctcccacccccagcccctgggtacacagagagtgggcctccagggcctccagcagctgaggggtgcagtggcgtcttggagaaggggctcacggtccaggggttgtggtggtgggccgcagcggcagagagggctgctttgcccccgtccagccagggcaaacccgggctgtgcaacaagtgtgggcggcacatctggcctccggtcaggcgggctgcgggcaaagagagagaggatcagggtgggcagaaagatcagggtaggcagagctagggacgcccctgacagacattgagatcacgactcccagaaccagcagtcatcccctccccaaagaaagccagaaacataataccccaccggtaataatcaggaatgtcagtccaagctgaaggacaagtggcatagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcgcattcagcacggccgggtgcgccatccagcgcggctgctcgggcgccacctccatggccggcggcggcggctcagggtctgggtgcagacggcaacggccctgcgcgaggaagggggagtgaggcgtgccgccagcgcctgacaccccccaaagtcccaccacgaggtgtcccgcacgccacggagccccagcccagatccggcgagaaagagcaccagtcccgggtgggaggaaagcccaaggctcaaaacgaaaggaaggcgggggagggggttcagccacgcacactcacgtggtgacccgcggctccagaatcacacacccgtgcacatggggtcacgcccggggacgggtcccgacaccagtgaccccaacaaacgcacagagcagcacttcagtcagacactcacactgagcccccccgcccggtagacaaacacatgaacacagactcaaaagttggagacaggcgcccgggcacccagtgtggcacttgatcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagccccgagggcgacgggcccagggacagcacgtccggaggctggcggggcttacagggtaggagctgggggtagagtgcgcctcggcctcgggccctcccggctccggcccctcggcatcctccggccgccctggcgccagctgccgactcctgcacagacatgaagcgggggccgcgcacgcctaagaagcccaagccagccaatcaacgccgcgcgcctcccagcctccgcctcccattggctgcgtccgcaattcccgaaccgctggactccgggactgacccgcgggccggcccccctcagccggcgggccccctccctgcgcgctcctggcggcccctgctgccaacgcgccccaccactaagggaccctcaccccaaggcccgacccctgcagcccctcttgcgaacactccgggatccctcgatgctctgggcctccctagcagtaactaaccaccaactgccccctccccaggagcccgggccgcacaccctctggatggcctctccccgagaccctaaccccgccacgctccttcaccgctgaacgtggtcagtccgagcgcagttacctacccagaccgttccctcccctagctcgggcgctgtctgggtggactgggggttgggatggttcggacgacagcggcggaacagcaggagccgagaggggcagagaggggcaggaactacagggctctagagggcacctgggcctcggacacgcggccgctcagggctgtgcttgacccagt

SEQ ID NO: 1727 - DNA, 8500 bp, Homo sapiens
  source 1..8500: mol_type = genomic DNA
gggcattcacaaaaagtattttattattcttaacagtactcactttaaaggaataagaggatagcatacattttttacagacaatatataaatgttgtacataattaacaataacttagttcactaatccaaaataaaacaagccaaataaaacataaaaacagaaaatactgccgattctttttcttatgcggacactagtacaaaataagttacttctggccgtggtgctccctgcagcgactgcccgcccatattgcacttggtcactacatcagcacaatcctcctcctgggccaggggcccctcacaggccaccacaccccgccgtcaccgcatacagaatctaagctcgggacacgtttatatacagctgtaccttgggaaggatccagacagccacagtaaagctggacctgagaccccagcagggacacagcctctccctgggtcctggtcctgacctgcccccaactcctgccttcaccccctgccaggccagcaaatgccaaccagcccccagaaaccaagggcagcaaaggcccctccccacccccagctttcatactagggctgtgggatcccagctcttttccaaaaagaattgcaaagctccaaccttgtgtgtaggttttattcctttcatagcagggctcctgtggctacgtacaatcaactggacccaaaaagagtttaaaaataaaacaattaactcatcagcgagttaagcctatgcatttttttaatattttttcttttgtctcagagtaggaggcgagggggttgaagggttagcagaaaaaggatgtatttacagggtccacctgacaagacaggctgtggcttgcgctcagtaaggggacacagtcacagcagcttcggcctcaaagccaagggagcgatctgggagacgtttcccctttcaagaaaatgttgtttccttcctgtgacccagccctggcctgggaatctgtgcaggaccgcccgtgattgtctctgccctccagggcctggcccgtcaaagcaggcaccagctcaccctccctgggccgtggccactctggctttggctcagcccagcctggagttcggctatttcagagagggaagccagaggagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcggtcaggtgcggaggcagcctctcagcggtggggaacattcacagtaactgctggcaggctgctgggcgccctccaggagagggggtgctgggccgagccgggctggcaggagtggtgtcggccttcgggaaatgctgggctgctaagggtttggtccacccatcccgggagtgcccggtcctcgacgtccatctgttccctagcccatggcggtcaccatgctggacgggtgggggtggccgaaggagaggctggaggaggggtggatgggcgtcggagtgggcaggatgtgtccggagtggctgaagggcgggaggtggcccacaggtgccatgtgtccagccagggcagctgcactgaagggggatgacttctcctgcatgcactttgacagctcctcgaagcactccgcccctttcttgctcttcttggacttgttggacatcttccggttccgagtctggatcccttccttcttcatggtcagtggcctgttaacctagaggcaaccaccagttttcagagggccagttccttcctccagcaacattcctcccaccccgccacagcgtggaccagaggcaggtcaagctgagggtcccaggaagccaggaattgtgcccgaccttcatagtcccatcaccagatggctaccattccaggaagggcgggttctggcatatggggctgacccacaccctccctggctctgcccaccgcatgccagcactgcccagccaactgaagtcctcccccccaccctgaccctttttaagcagagaaaccacttccctagtccgagaccctgtcctagccagctccacctcctgagcagaggcaaggcacccctcttacgggaagcccttctggcgctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcgtcagcaggctggactcccacgcccacctcgacccccctccctgaccctcgctccacccccagtccccaccagctcagtcaaggagggctaaatctcacatgggaatcaaagcatctcagaaccatggaattttagaatttgagaacgaaataagtcaagactcacagaactttggaataaagaactctcagaagcctgatgttagaatcaacgggattgcaagagctacagaggagaattagctacctcccccaactaccctgcgctctaactccataaatggggaaactgaggccctgagaagggctctctagtagcacaggcatcctgaggctgagccggcttggtccccctcgagcccctggatctggggccgattctgtgtctcctctagcacgactccgctcaaaatccataatcctgggtgagtcagtgtcgctgaggccagcgcaggtttacagagtgcagagctgcaccgtccaacactgtagcagctggccacaggcagccatttaaataagatctaactacaaattaacaaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccgcagcccctctgagtcctagtccctcaggaaatgcctggcagaggtagggtctggaaatgagcgcctggtccttgcagagagaagctagagggaggctttacccaagaaaacagatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagccgcgggggcagggaggggtgagtaagcagcctgaagctggaattctgactcaggggccaacgccgcgtcctccacctctacccccacccgggcctcaccccgccctcgctccaggggaaaaaaaggcccccaaagcagggaacgatttaagcctcataaatcacttcgccctgaaaaaatatatttattattcttagcattttacgcattatttgcagagtggagggtattagaaatttcaaaacagcccagcgagaggcaggactgagctgaggagactctaaaaactcgcagagtccggaaacagatacacgaagtttccttatcttcaggctgcagatgtccggataggaaactccggcaggagatccgaaagggcatttttttaaaatcactcaaatgaaaatacacagtataggtgactccatggaaaaataataaagggcaggtttttttagtggccggtgtgagtttgtgttttatttaaataagcacgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtcttcgcttgggcttgatgagtggtcggttctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggacgagagggtctcccacatgggagggggcacaggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgccccaccccgtctttctgctctaagtccagaagcatttccctctttctccccaacttttctcctcttccaccaaagctctagaatttttctgagtcctggaaataatggatcgaagttgttgttctttaaaataaaataaataataagctctttcttttttagataagtggcctgggttttttttgtttgtattttttttttcaattaaaagaccatctggaattcaaataaaatgcaaaacaaacaggagaaaggaccaagaaaaggcaagctgacgggtctgagcagaactaggaccctgagccggggctcagcgggtgctggggccagcgggggctggggctggggaccaagttgagcaggatcactggctggcatcgtgttccccaggaagttattcttgatttagtttaaactaaatgaggagtacagcctggcaagagaaggtggttcctgcactcaggagtaactgttttaaaaaccttccccctctgtggctcaaagggattcgggaaagagacatggacagcaagaactccacactagccacgagtttctgggtttatgctctgtggccagattcttggacaaacccagtttggccccagccagctgcgggaaaaggggcgggggcactgcagcttcatcccctcactccagccctcagggagggagagggaagggcctggcgagggcagggagcaggagcaggtcctgggaattttgctctggggaaaatctcccgaggagatcagggagccatcgaaatcccaagatcagactgattgagttagagacccagattccttaatggtctggaacctccggagtgcctgaaacatgcacacacaacatgcacacagacacacgtatacacatgcacacacgctcccaaacacatgcacatacagagtcacttccctcgcttcacatactaagtcctgaggtggcttgaattttcacttaagattcagggagggaaagggggaattcctgttctatgttctggtcaggcagtgaccaaccctggggcaaggaactgaactttgggggtacactggaagcacttaagaaaatggcaaaagttttagagtctcctctccctgacccgggggtctcaaacatctgctgggggctattagagcgagacatcacccatccccagatctgggaaaccaacactgccacctctcccaagtcacagctccccaccacaaaaacgcaaatgctcccctcttccacgaagtccccagcacctgcctttacctgaacaggaacgagccttgctgcgctgcttaggggtgaagctggaggccggtccccccaggaagcctccggggtggaagagtccgctgctgtagtcgtgggcagccgccggcacataggaggggtaggtggggatggggtggtgtgtagcaggctgggtgcccatagtagctaggcctgggcgcaggggactgccactttccatcttcatgctctccgtcagtgacacctggtacttgacgccgtccttgtcctctcctcgggctgcactaccccccgcggaagatgaggctggagacgcagcccccgtggtgctagggtcaggagacacttctttgggtggcgtgggtgggaagccgaaaaggtgggagccagagtgggctgctgtaggggtgagggaggccactgagctcccgctgcctcccccgctcccacccccagcccctgggtacacagagagtgggcctccagggcctccagcagctgaggggtgcagtggcgtcttggagaaggggctcacggtccaggggttgtggtggtgggccgcagcggcagagagggctgctttgcccccgtccagccagggcaaacccgggctgtgcaacaagtgtgggcggcacatctggcctccggtcaggcgggctgcgggcaaagagagagaggatcagggtgggcagaaagatcagggtaggcagagctagggacgcccctgacagacattgagatcacgactcccagaaccagcagtcatcccctccccaaagaaagccagaaacataataccccaccggtaataatcaggaatgtcagtccaagctgaaggacaagtggcatagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcgcattcagcacggccgggtgcgccatccagcgcggctgctcgggcgccacctccatggccggcggcggcggctcagggtctgggtgcagacggcaacggccctgcgcgaggaagggggagtgaggcgtgccgccagcgcctgacaccccccaaagtcccaccacgaggtgtcccgcacgccacggagccccagcccagatccggcgagaaagagcaccagtcccgggtgggaggaaagcccaaggctcaaaacgaaaggaaggcgggggagggggttcagccacgcacactcacgtggtgacccgcggctccagaatcacacacccgtgcacatggggtcacgcccggggacgggtcccgacaccagtgaccccaacaaacgcacagagcagcacttcagtcagacactcacactgagcccccccgcccggtagacaaacacatgaacacagactcaaaagttggagacaggcgcccgggcacccagtgtggcacttgatcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagccccgagggcgacgggcccagggacagcacgtccggaggctggcggggcttacagggtaggagctgggggtagagtgcgcctcggcctcgggccctcccggctccggcccctcggcatcctccggccgccctggcgccagctgccgactc

SEQ ID NO: 1728 - DNA, 13766 bp, Homo sapiens
  source 1..13766: mol_type = genomic DNA
gggcattcacaaaaagtattttattattcttaacagtactcactttaaaggaataagaggatagcatacattttttacagacaatatataaatgttgtacataattaacaataacttagttcactaatccaaaataaaacaagccaaataaaacataaaaacagaaaatactgccgattctttttcttatgcggacactagtacaaaataagttacttctggccgtggtgctccctgcagcgactgcccgcccatattgcacttggtcactacatcagcacaatcctcctcctgggccaggggcccctcacaggccaccacaccccgccgtcaccgcatacagaatctaagctcgggacacgtttatatacagctgtaccttgggaaggatccagacagccacagtaaagctggacctgagaccccagcagggacacagcctctccctgggtcctggtcctgacctgcccccaactcctgccttcaccccctgccaggccagcaaatgccaaccagcccccagaaaccaagggcagcaaaggcccctccccacccccagctttcatactagggctgtgggatcccagctcttttccaaaaagaattgcaaagctccaaccttgtgtgtaggttttattcctttcatagcagggctcctgtggctacgtacaatcaactggacccaaaaagagtttaaaaataaaacaattaactcatcagcgagttaagcctatgcatttttttaatattttttcttttgtctcagagtaggaggcgagggggttgaagggttagcagaaaaaggatgtatttacagggtccacctgacaagacaggctgtggcttgcgctcagtaaggggacacagtcacagcagcttcggcctcaaagccaagggagcgatctgggagacgtttcccctttcaagaaaatgttgtttccttcctgtgacccagccctggcctgggaatctgtgcaggaccgcccgtgattgtctctgccctccagggcctggcccgtcaaagcaggcaccagctcaccctccctgggccgtggccactctggctttggctcagcccagcctggagttcggctatttcagagagggaagccagaggagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcggtcaggtgcggaggcagcctctcagcggtggggaacattcacagtaactgctggcaggctgctgggcgccctccaggagagggggtgctgggccgagccgggctggcaggagtggtgtcggccttcgggaaatgctgggctgctaagggtttggtccacccatcccgggagtgcccggtcctcgacgtccatctgttccctagcccatggcggtcaccatgctggacgggtgggggtggccgaaggagaggctggaggaggggtggatgggcgtcggagtgggcaggatgtgtccggagtggctgaagggcgggaggtggcccacaggtgccatgtgtccagccagggcagctgcactgaagggggatgacttctcctgcatgcactttgacagctcctcgaagcactccgcccctttcttgctcttcttggacttgttggacatcttccggttccgagtctggatcccttccttcttcatggtcagtggcctgttaacctagaggcaaccaccagttttcagagggccagttccttcctccagcaacattcctcccaccccgccacagcgtggaccagaggcaggtcaagctgagggtcccaggaagccaggaattgtgcccgaccttcatagtcccatcaccagatggctaccattccaggaagggcgggttctggcatatggggctgacccacaccctccctggctctgcccaccgcatgccagcactgcccagccaactgaagtcctcccccccaccctgaccctttttaagcagagaaaccacttccctagtccgagaccctgtcctagccagctccacctcctgagcagaggcaaggcacccctcttacgggaagcccttctggcgctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcgtcagcaggctggactcccacgcccacctcgacccccctccctgaccctcgctccacccccagtccccaccagctcagtcaaggagggctaaatctcacatgggaatcaaagcatctcagaaccatggaattttagaatttgagaacgaaataagtcaagactcacagaactttggaataaagaactctcagaagcctgatgttagaatcaacgggattgcaagagctacagaggagaattagctacctcccccaactaccctgcgctctaactccataaatggggaaactgaggccctgagaagggctctctagtagcacaggcatcctgaggctgagccggcttggtccccctcgagcccctggatctggggccgattctgtgtctcctctagcacgactccgctcaaaatccataatcctgggtgagtcagtgtcgctgaggccagcgcaggtttacagagtgcagagctgcaccgtccaacactgtagcagctggccacaggcagccatttaaataagatctaactacaaattaacaaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccgcagcccctctgagtcctagtccctcaggaaatgcctggcagaggtagggtctggaaatgagcgcctggtccttgcagagagaagctagagggaggctttacccaagaaaacagatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagccgcgggggcagggaggggtgagtaagcagcctgaagctggaattctgactcaggggccaacgccgcgtcctccacctctacccccacccgggcctcaccccgccctcgctccaggggaaaaaaaggcccccaaagcagggaacgatttaagcctcataaatcacttcgccctgaaaaaatatatttattattcttagcattttacgcattatttgcagagtggagggtattagaaatttcaaaacagcccagcgagaggcaggactgagctgaggagactctaaaaactcgcagagtccggaaacagatacacgaagtttccttatcttcaggctgcagatgtccggataggaaactccggcaggagatccgaaagggcatttttttaaaatcactcaaatgaaaatacacagtataggtgactccatggaaaaataataaagggcaggtttttttagtggccggtgtgagtttgtgttttatttaaataagcacgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtcttcgcttgggcttgatgagtggtcggttctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggacgagagggtctcccacatgggagggggcacaggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgccccaccccgtctttctgctctaagtccagaagcatttccctctttctccccaacttttctcctcttccaccaaagctctagaatttttctgagtcctggaaataatggatcgaagttgttgttctttaaaataaaataaataataagctctttcttttttagataagtggcctgggttttttttgtttgtattttttttttcaattaaaagaccatctggaattcaaataaaatgcaaaacaaacaggagaaaggaccaagaaaaggcaagctgacgggtctgagcagaactaggaccctgagccggggctcagcgggtgctggggccagcgggggctggggctggggaccaagttgagcaggatcactggctggcatcgtgttccccaggaagttattcttgatttagtttaaactaaatgaggagtacagcctggcaagagaaggtggttcctgcactcaggagtaactgttttaaaaaccttccccctctgtggctcaaagggattcgggaaagagacatggacagcaagaactccacactagccacgagtttctgggtttatgctctgtggccagattcttggacaaacccagtttggccccagccagctgcgggaaaaggggcgggggcactgcagcttcatcccctcactccagccctcagggagggagagggaagggcctggcgagggcagggagcaggagcaggtcctgggaattttgctctggggaaaatctcccgaggagatcagggagccatcgaaatcccaagatcagactgattgagttagagacccagattccttaatggtctggaacctccggagtgcctgaaacatgcacacacaacatgcacacagacacacgtatacacatgcacacacgctcccaaacacatgcacatacagagtcacttccctcgcttcacatactaagtcctgaggtggcttgaattttcacttaagattcagggagggaaagggggaattcctgttctatgttctggtcaggcagtgaccaaccctggggcaaggaactgaactttgggggtacactggaagcacttaagaaaatggcaaaagttttagagtctcctctccctgacccgggggtctcaaacatctgctgggggctattagagcgagacatcacccatccccagatctgggaaaccaacactgccacctctcccaagtcacagctccccaccacaaaaacgcaaatgctcccctcttccacgaagtccccagcacctgcctttacctgaacaggaacgagccttgctgcgctgcttaggggtgaagctggaggccggtccccccaggaagcctccggggtggaagagtccgctgctgtagtcgtgggcagccgccggcacataggaggggtaggtggggatggggtggtgtgtagcaggctgggtgcccatagtagctaggcctgggcgcaggggactgccactttccatcttcatgctctccgtcagtgacacctggtacttgacgccgtccttgtcctctcctcgggctgcactaccccccgcggaagatgaggctggagacgcagcccccgtggtgctagggtcaggagacacttctttgggtggcgtgggtgggaagccgaaaaggtgggagccagagtgggctgctgtaggggtgagggaggccactgagctcccgctgcctcccccgctcccacccccagcccctgggtacacagagagtgggcctccagggcctccagcagctgaggggtgcagtggcgtcttggagaaggggctcacggtccaggggttgtggtggtgggccgcagcggcagagagggctgctttgcccccgtccagccagggcaaacccgggctgtgcaacaagtgtgggcggcacatctggcctccggtcaggcgggctgcgggcaaagagagagaggatcagggtgggcagaaagatcagggtaggcagagctagggacgcccctgacagacattgagatcacgactcccagaaccagcagtcatcccctccccaaagaaagccagaaacataataccccaccggtaataatcaggaatgtcagtccaagctgaaggacaagtggcatagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcgcattcagcacggccgggtgcgccatccagcgcggctgctcgggcgccacctccatggccggcggcggcggctcagggtctgggtgcagacggcaacggccctgcgcgaggaagggggagtgaggcgtgccgccagcgcctgacaccccccaaagtcccaccacgaggtgtcccgcacgccacggagccccagcccagatccggcgagaaagagcaccagtcccgggtgggaggaaagcccaaggctcaaaacgaaaggaaggcgggggagggggttcagccacgcacactcacgtggtgacccgcggctccagaatcacacacccgtgcacatggggtcacgcccggggacgggtcccgacaccagtgaccccaacaaacgcacagagcagcacttcagtcagacactcacactgagcccccccgcccggtagacaaacacatgaacacagactcaaaagttggagacaggcgcccgggcacccagtgtggcacttgatcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagccccgagggcgacgggcccagggacagcacgtccggaggctggcggggcttacagggtaggagctgggggtagagtgcgcctcggcctcgggccctcccggctccggcccctcggcatcctccggccgccctggcgccagctgccgactcctgcacagacatgaagcgggggccgcgcacgcctaagaagcccaagccagccaatcaacgccgcgcgcctcccagcctccgcctcccattggctgcgtccgcaattcccgaaccgctggactccgggactgacccgcgggccggcccccctcagccggcgggccccctccctgcgcgctcctggcggcccctgctgccaacgcgccccaccactaagggaccctcaccccaaggcccgacccctgcagcccctcttgcgaacactccgggatccctcgatgctctgggcctccctagcagtaactaaccaccaactgccccctccccaggagcccgggccgcacaccctctggatggcctctccccgagaccctaaccccgccacgctccttcaccgctgaacgtggtcagtccgagcgcagttacctacccagaccgttccctcccctagctcgggcgctgtctgggtggactgggggttgggatggttcggacgacagcggcggaacagcaggagccgagaggggcagagaggggcaggaactacagggctctagagggcacctgggcctcggacacgcggccgctcagggctgtgcttgacccagtggaggtggcccggccggtggctccagaaagggggagggggcacccctccccgggcgtggccttcgcaggccaacgggcccaattgcctggggcgaggccgtggagacccggactggcgccggcgccagctggagggagacgcccccgggcaagaggtggcattttttttcctccggggggggtccccgaggtggcctctggtgagggggaggcggtggtctgaggtctccgtcttctaagtcacctggaagtgctccccactcacttctagcccggagatcggctctatggttcgtgtgggccgggcgcacaagtcttcctccctcccattgtacagactggggagacggaggctcgaagggagccccgggccgaggagggaggtccaggacaaaggcattttgggggacctagacaggtgccgagtactggggggactcaacagcgtcctccagccctcttccctgttgggcccgaggctcccggggtagatgtccagagggcccccaggtgggtcgggggcaggaggagggctggggtcccggccacccccgggagagtgggggaggggcggcgggattgacagtcggtaattgggtaactggaggcggcttctccggccgggcggccccgccaccgcgacgccgagcccctgacgtcacccgattcgccaggaaatgaactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtaattcgcctttttctcccaccggcgcggtaaaaattaccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaaccagcctccttgcccgcaatccggtgtagaggaaaaaaaggaaacaggagttctgccaggtcctttcaggccttggggttgccttcctcgacaacgcaggcaggagccggcttgaccgaagcctccacctcggttgcaggtcctgcgtaggatgcgggactgctgcattctctggcggaaacgaacccgcctgggagagagaaatgcgacgccaagtagcagggcgcccagctggccaataaagagggacccgcgctcgacaatgtctgtgtgtgccaggcagaccgagggacaccaaccgggcccctccccattaggccgaagacatggtcctcccaccttgggccccaaacaaactcccggggagggtcaacgcagcccccagaatctgctggggtcttgaggcgctgttccaggcctggtgagagcagatttactccaatttatgggctggaactttggggtccccaaaacacctttagagggacgcgttccctttttcagtactttgttcgttcgggagtatagttggaaatgctggcgctgcctttgatcacattaagaagctgtcactttccttacttgggaacaagatttctctgaggactggagaaggtcagccaggaagcagaattttcgaaggacccttttggcccgagaactcacagcggcgatcgccaccatttgacctgggtgcttctgcctgggagctggggaggtagcagatctggtgcccggttctagagtgcttctcaggcctctactaagccgcgggtgccaggtggggacacagagatgcccaggtctccccggccgtccagcccccccccccctctgagccctttgtttaaagttagctcatccgaggcggcccctttgggaccataagtttgccctccctttgtaacctaattcttctcgccttttccttatgggcagctaattggcccgcggtgtggggctgggggtggggtgtcaaggaaacccatttgctaagggactaccttccatagagaaatttaattcgcaacccagcggcctcccagccccacactggcaataaaccttgaggggtacggggaggaagtggggtgccttagcagatgggttcagaagttcccttaaagccggggcattagatctcaggccagcagccatccctccgggggggttcccaagggggggactactgctataacggcccctcctgctccttgaggttcaattccagccccttaaagcagaaggctccctccctcggcatcagtgcaggctctcccacctcattactgttctgtgtctttgggaatcgtagagtctgtggcccccacgtcctaggtgtctcggcaccctggacccaggcgcctccgagattctatatcgcttctgacccctaccttcaagcctggcaggctccccgcggaaccctgctgagacccggagacaatcgggccgtgcttctccctcctccacgaacagccacggtttatttggagcggccggggccggcggcctgacaactggtaaatccgtttcgttaggcacaatttgtctgcaatttgtcagcccggctgggaaacgctccccagacgcctcggctgccgcacgggccctacctggttctcgaatcctgcctgctcataaacgaatcctagcacggggtgcctgcgtagacctggagctcaccaccagatgttcccgacctcgggagaggaggctttttccaaaacaacgaatttccttccttgttttccggtaaaggagcgttcgccacacacggggtccctgaacgcggggcctttcccctcgtggttggagcaacgcggagttcaagcctggccgccacagaataattttaaatgccccgttttcagacagatccagaacgccgtctacgcctaccggcggcagatcttcaagcccgcggcggccccattcttattgaaatcccactaaacggattccgactccggcttggggcggggggagacttccagacccggcgctctcccccacacgcaccccagtcacacaggataaagggctgcggggcgcagcgcgcgggggcgcaagcaggagcgagctgggttaagccgcgaaaagccggcgcacgggaccagccggcaggtgcagccgccgctcggcggcccggctcggacgcatccgccgcggtggcctggggattgggggcggccgagacaaaggccccagttcgggggccgggaggcgggggtgctttgcgaggctctgggaatgccagggtctcgtggcctgtggctccgagaaatgggaagacaagaggcccgaggcgggcctgctgtgcccaggtaaccaaatactccctctggttaaagtccctataaccagggtttccggtctctggcagggccaaggcgagccccaaaggtaggggccacagggcaaacggaccaagcgattcgggtgccaggcgggccgggccgggggcgggaagggccgggcccagggaaggtggaagtggaagaaactcaccgagcgaggcgcggtgggcggcgcccccgggcggacggggcctggagtagagctgggagcagggcgaggtgcgcggcaggcgggctcgcgggacctgggcgcggggtggcggcgctcaccagcagagcctgggcggcacgccgagcggccgcatggtgttcagcggaccgcttttgtccgcctggtgggcgacggggccctgctaggatggatgtggcggcaggcaatagacagacttgagcagcgagtcccggggcgacgctggcctcgctaccttcctggcgctcac

SEQ ID NO: 1729 - DNA, 12116 bp, Homo sapiens
  source 1..12116: mol_type = genomic DNA
taatactcttaatactttattaacttaaaacatcactctaataaatatgtattaacaaacataatgcttaccagaagatctaaaaacatttaccaacctcatcaaagtgaaaataccacctttcccccctctatggtacacatggagggtcaaagagttgaagacagagccttccttcccacatgcctgctagctcagaaatctttaaaatatcagcttaacaataaaaaactgaatatacacacatatctttgaagtaactgttcagctttttgtttacacctgataaaatccaaaagggtcaaaagggaaggtttacaattctgtgctgtcttctcagaattccctccaagagtaagaacagacccagccacttggaggtgcaaccgttagcttttgaggagcagtcaggggttgtgacttcagtctctcttccccaatacctagcatggtgcctggtaccttggtagccggtgatccatgaacatttgctgagtgaatgaatgacatcttgtccacaggcattgcttgtgcttttacctccagtgatgaggttttcacagccctactgaagggaggacctctaatcccctctcattaccaacttctcttctgcttcttcttgggggtagcctcgatggtgcatctcatgacttcaaagtattaaattccttccccaagtcagtttctgaatcagtttttgaggaggagaaatgattcctccaagatttataggcagcacccaaaagaaaggagtcaacagaccccccagaaggaaaaaaataaaagttaacactcactcttctttctagataaaaatattagcatttgtccaccttgtaaatggtgattcctcctcttccacacaaatatctggggtaggtcaagaggggggagggaagaaacctgaagggcattcctgtctgtagattagggctggaaatgggaaggactgtggggtctaagatttattctggtccccatttgactttgcctttgtcttcaggtgtagaggagcctatttgtgtccgaagcctagagagtcacttggttctcactctcggctgcactttgaaaaggtacctcatttcttctggcagctccaggaggtaaggcgaaggaggagcaacctggtaggatctgcagactggacctggggtctggaaagtcagaagggagtggaggcaagcagggagcagagtggtggcaagcagggaggctgccctctgtagtgttgtgtagctgctgcttgcagccagccagggtgctcatttgagcccatgctgcgtctcccggtgccttcggaggtccaccttcctctggaaacccttcccacagaggtcgcagccgaagggcttgaagcctgtgtgtttgcggctgtgggtgatgaggttggagctctggctgaatgccttgccgcacacctggcacttgtgaggcttctcacctgtggggatgggagggggaggggagaaagtatgagtctatgataaagctagaggggacccactgtgacccacatgctcttggcagcagctggttgcaccacagtctaaggccttcaagcaacttggagggtgacgtgttgcaacctgaactgactcccagcctgcaatgcgagtccctggaagcaccatgggggcaccaggtgaaagggagactttctgaaggggggttcccagccaaaggcctcaaacggtttcctgctaaacggaaacagagcaaaggccacgtgccctccccagctgaatctaccccgggaggactcccctgactttataagccatgaacactcagagcagatgttcaacaggaaggggagggggaagctgtcctaaaaccgtgtgactccgttctaattcagaggaagttttcaaatctgaatttccaagtgggtgttagtttgtatggatcagtgagcccgtcttctttcttgttcttgaaggacagcagattatatctgaaaaaacatcttaacatggactttctttctttctttatttctctctctctctctctttctttctaagttccggggtacatgtgcaggatacgtttttcaatatcttattttaaaaatccacatttgggccacaaaggattaaggcagctgatactttactgtcttgatttttccttaattttatggggttaatcacatgattctttatataccagcaattcttcaccacaaattaataaataagagaacacaagaaggttttgtcttgttccccatctcatgtgttgttgggtaaatggcatgaatttccaatagcccagcatggcattatagtcagggctcagccttggaaaaagtataaaatagatgaagtttgtttttgaggaaccctctgtcctccttgctaaaaactcttttctgttttcatgcttcagatttccttgataagaaaccacccatcaaaatgtattctatccctttagggtcaaacaaatctgagaaaacaaattctaggtataacgtaaatgtttgataagggcttaatgttttattcagtcaagatcctagttgcattttgataagtgtcctgaataccttacttataaggagtgaattacatggaaatttcaggtaagagggaatgattaaagtagaatacttttctgggttttcaatggaaatatatacattacccaagtatatttataaacatcaagggtgggtgtttagaatacactgtgatttgttctaaatcagtattcatattctgcaataaaattttcagaaattctgggtctcatgtaaatgtcttttgactattagagtgttcttggcattaaaactcccacccgcacataaagtgttagacaaacagtccaggattaaaagccagagcattacatggctacattattcattcagtcttacttctgataaatcattcactctttctgagtttcaggatggtaagagcagctccttctactttcttgagtggcaataagaatcaaatgaaatgatagatttgaaagtactttgtaaattataaagcattataataggtaaggaattatcattattatggcattaacttgcagatattttgaaaagggcaataagtgaacagaagctttctgtctaccaacctcatgactctgaacataaaatacaataaacagtggtcaagagtgaacatttgagaggtcagacctgaatttgagctctggccctgtcatttgctagcagtgtgaccctgggcagattacctagcctcatttttttcatctctaaaatggggagaaggagtagtcgctacctctcagagttgttgtgagcataaaatgaaataatgcatttaaaaaatgcttagcagagagtttaatcatatttgccattatttgttcctcttcaatcagaataagctctcagactcctgaaaatgcagccggagagtccacacgagtccctcccacaaaaggccaggtggttagggaaagtcctcaatctctaggtaagctttagagcaactctctaagaggaccctggagcttcatatttcacccagagcaggcagcaggggaagcagctgctaacctaaaggaaaatgttctttccaagtatagagtacctgtgagctgacctgctgagtggcctttcagacacaaccccaaatcaaggtggctctggggagaattatgccggtaaatgaaccaaagaacccacccctttgttttctttaacacagagcagagaataactccatcagaaaggcctcatccaccactcactggggccagaaatcagagaagatgagtaatgttggcctcagggtgtttcctacaagccaagggcctttttagctcaccagtgtggatgaaagtgtgtttcttcatgtctgacttctggtggaacctcttgccacagtactgacaggggtagggccgagtgtctgagtggataagcaggtgtgtggacagtgtggatgacctcttgaagctcttcccacagatcttacagtcaaagctccgttcctgcagagagagagagagagagagagagagagagagagagatgcagaactcctactgcagtcaactagactgctgctctcctcacccctcagctgaccctaaaatcccttgaacactttttctttctttttttgagacagtctcctctgtcgcccaggcttgagtgcagtggaacgatctcagttcactgcaccctccacctcccaggttcaagcaattctcgtgtctcagcctcccaagtagcagggactacaggcacacgccatcacacctgactaatttttgtatttttagtagagatggggtttcaccatgttggtcaggctggtctcaaacacctggcctcaagtgattcgcccacctcggcctctcaaagtattgggattacaggcgtgagccaccgtgcctggcccttcaacactttttctaccaaaacattcttcacccacaaccttccacaccccatggcaaatacatatccacaccctgctttttttgacacccattagcacacacttctccaccctcctcaacaggaggcttagacctcagtcacttgagatgccacctccccccagccagtgtgggtgctgggggagatgggctaatactctttttagccttcgtaagtaggcattctcctgagatagctattggcatatttacttgctcatctactctccatctctcagctaaactataatcttcatgtgggcatgctgtcaaggacctgatgtgttataagattcttaagtacttggcacctggaagttagccaacaaatatttattaatgaatgaatgaataaatagcggcggtggggcatggtggctcacgcctgtaatcccagcactttgggaggcccaggctggtggatcacttgaggccaggagttcgtgaccagcctggctaacgtggcgaaatcccgtctctactaagaacacaaaaattagctgtgctgtagtggcatgcgcctgtaatcccagctacttaggaggctgaggcacgagaatcactttaacctgacagggggaggttgcagtgagctgagattgtgcaactgccctccagcctgggcaacagagccagactctgaaagaaaagaaaagaaaaaagaaaagaaaagaaaggaaggaaggaaagaatgaatagcggggtgaatatgctactagatgctctaaatgagctgagattcctgccttttcagtcgagaggggtcaatgcaaattaagtgacaaccatttggtgaaaagaataggcacaaagaaacagagctagtaagtctgatatatcagcagcacgaatcagtgcatacaaacctacctcaagcccaaagtaacaatgaggatcacactctcgaggctcacagtggtgtgacaccaaaatccagggctgcctcaaggcctgagccggccacaatcctcctttccctacacacctgcaccagggcaaggggacgcagcggagggcttgggggaggaaactgggggaagtcgaggagaaaacttccaggcagagagtggctggtgctgcaccgaggagatgcagaagatccccgagcagggccgcgcgcggcggtgcgccccgcgcttacctgcgagtgcacggctttgtgctgctccaggctcaccgcgtgcccgaaggtcttgccgcacatctcgcaggcaaagggtctggtaccgctgtgggacctgcgcacgtgcacctcgagcccgtgcggcgtggagaacacctaaggcgggtggggccagagagaaggccgctgagaggggccgcggggcgcaggcgaggcgcgggtaggggaagcgggcgcacggcaggcgaggtggtgagctcgggagcctcaccttgctgcacttgatgcacttgtaggagccgccgcccagcagcaggcgggtgcacagcagctccgactccaccttgacgccagcgcccttgtctgcgtgcagcccgtggccacgctcggggtacagcaagcccgccgctgccgtgggcctctcatacagcccggctgccgcagacccgaagtcgccgtagagccctaggccagggccagcggtggcaccggcccctgcgctgcagctccctggcgccccggcccccgcgccgccggcagcccgcttcgggccgtacagcgcggccgggtggccaggctccggggcgggttcgcagaagaggcccaggccagcgccacgctccagggccccacacggtcggtagctctgcaccaggtgccgcaggtcagaacccgccaggccgctccatgagtacggtttgaaaggcagggggaagggctgggcttcgtccagcgatgggcacattgacttctccgaggctgtggaggcacaaggggagcgtccggtcaggcttcagacggcagagcggaggccgccgggctgcggctgcgagcgtggcgtgttcgcggactgcggggcacccagcgcttgtagaacactgcgtgcgccaggtgccaggctcgccccagggtaaaacgtggcccgggccctggggcctcgcaggccactataggaggcagaacagtaaacagatcattgaaaagacctcgggagaggaggtcgtaaattctgtgcgagtgcagcggaggcgctcggcgttccgaggatcttttctggctggacccgcgcacctggagatcctacagggaagggcgcatctataaatgcccgtagttgagctgttaagaaggagaaggtggcggccgttcggcccctcacagcactcaagggcggaagggtccagccaccagcgcaggcactctcccagcccctacatgttcccattcaattctttttcttcccagaatccaagaggaaggagggagaaggtccataaatgcggccccgaactacccgaaaggctgctgtctgaataaacccgaaggtattaagatttcacgaagttaagtgcccagtgtacgtagcaaaggagcagcaggaaaggggcttttgggcttaaattgacagccaaatactccccattcctgttacagtttgatggaggcggggaacctgaatttctcagagaataactataactcataaggtttagccaccacctgcaaggagacagctctgaattctcggcctgctacgcccccacccacgtgaattttgctaaaactagtgaccccaacgcatgtgagtgcatacggcatttacaaatgtgtgtgtgtgtgtgtgcgcacaacactccagttcaggctggccacttcagtgagaggctgtacccggagtttcgttcggaggggttcggggcgcgcccaatccttgtctggccacttgacgccctggcaggaagaatcctcccgccgccggctcccagacacacttgctggagctatggttttcgccaagtcaactcactgattgtgggacgggtggtggtatcttctaaaactagcaaacatattctggatataaccggcccttgacagaatccggctggtctgctcattccttcccccggccgggactcgagacgcccccacccaacgtgtggtcacttagtttgcctgaagctggattgctcgctggaaatgaaacccagagagcaggcccctgaggctaggttaacccggcaaaacgaaaaatgaaacaggcccccaatctgcgcctgtgaagaccaagccgcgggctgagattttcgtcctgccccctccctgccgcccagcgcctagctcctctgcctggcccgttctgccctgttctctgtttgaggtttgggggtctagattgcaggatcctagcactttataaaacagtcaggtctggtcagaaaatgaaaggtcagcgttgccgccagtcgaaacgactggtttgttttccgtcactggccagctccgcgcaaacgaatctaagcgacaagcagctagggtcctgccgcctgggatggaggcagcagccccagcgggcaagctgtccaagtcccagagaagccggatgcctccttcccctacgaatcagctcccttctcccggaaagactctccaactccccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctcagcggtaaaacctgtcccggggccctgtctcaggcccctttcctcctccctgcccacgccccccagctcctcccctttcctagcgaagctcgctccggcaatcaaactccctggagagctgtagttcccatcgggtgggttaccccaactcagctactcatcgcctgcctggctgtgctttacggctggcgagggagggcggggacacgcggatcggtttaggggccggggatgcccagtggtcgaggacccggaaggggcaaggagccaagacctccaagagccagctaccaactggagtgaaaggaccggggggaggggggaacagaacacaagataaaactgtggggcggcgggaggacagcagcagagggattggggacagcagaggccagagaaaggaggtgggagagcaaagggacaggaaagtgaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagctgcccggggcgtcgctctcattaacccccaatcagttcacctaataccaggtcgaaatctgagcgcagcgggagggcgtggctgcgcctgccgctaggctccagccggctccgggggcggtaccccacagtcgaggtggtctggagtaaacgaatctgccttcctcccggggtgaaggcgatggtgaccgggttcacacgtgagctgcagtacagcagttctccgtggcctcggctggttcagaaacgagggtgctgggaactctgggccggggcaggacctgcagtcctccggcttcgcgctgtttccactgccggactaggagcccctcggcttcctaggcaagatgcaggccacacagtctacgtctgtccgttggcgctctcagctcaaacgagtcctacaggccttggtccctgtagggtgcaggccccctgctccagatccccagccccattgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatcaccggcccgcggtgccgccggcctggagcccggcgagtggccacggcgtccgcagagcgaaacctgccccgcaggccccgaaatagcttgttgtggaaacacttggggataaatacgcccaacgaggctgaaaataccttgacacccaatccgagaggtttgctcatttcccttcggatttaggtaatggttaaatttggaagaggtgggcgagcgccgagcccccggcggagagggccctggcggcgcgtcccgcgggcgcccggcgggaccggtgggcgcaccctc

SEQ ID NO: 1730 - DNA, 9039 bp, Homo sapiens
  source 1..9039: mol_type = genomic DNA
taatactcttaatactttattaacttaaaacatcactctaataaatatgtattaacaaacataatgcttaccagaagatctaaaaacatttaccaacctcatcaaagtgaaaataccacctttcccccctctatggtacacatggagggtcaaagagttgaagacagagccttccttcccacatgcctgctagctcagaaatctttaaaatatcagcttaacaataaaaaactgaatatacacacatatctttgaagtaactgttcagctttttgtttacacctgataaaatccaaaagggtcaaaagggaaggtttacaattctgtgctgtcttctcagaattccctccaagagtaagaacagacccagccacttggaggtgcaaccgttagcttttgaggagcagtcaggggttgtgacttcagtctctcttccccaatacctagcatggtgcctggtaccttggtagccggtgatccatgaacatttgctgagtgaatgaatgacatcttgtccacaggcattgcttgtgcttttacctccagtgatgaggttttcacagccctactgaagggaggacctctaatcccctctcattaccaacttctcttctgcttcttcttgggggtagcctcgatggtgcatctcatgacttcaaagtattaaattccttccccaagtcagtttctgaatcagtttttgaggaggagaaatgattcctccaagatttataggcagcacccaaaagaaaggagtcaacagaccccccagaaggaaaaaaataaaagttaacactcactcttctttctagataaaaatattagcatttgtccaccttgtaaatggtgattcctcctcttccacacaaatatctggggtaggtcaagaggggggagggaagaaacctgaagggcattcctgtctgtagattagggctggaaatgggaaggactgtggggtctaagatttattctggtccccatttgactttgcctttgtcttcaggtgtagaggagcctatttgtgtccgaagcctagagagtcacttggttctcactctcggctgcactttgaaaaggtacctcatttcttctggcagctccaggaggtaaggcgaaggaggagcaacctggtaggatctgcagactggacctggggtctggaaagtcagaagggagtggaggcaagcagggagcagagtggtggcaagcagggaggctgccctctgtagtgttgtgtagctgctgcttgcagccagccagggtgctcatttgagcccatgctgcgtctcccggtgccttcggaggtccaccttcctctggaaacccttcccacagaggtcgcagccgaagggcttgaagcctgtgtgtttgcggctgtgggtgatgaggttggagctctggctgaatgccttgccgcacacctggcacttgtgaggcttctcacctgtggggatgggagggggaggggagaaagtatgagtctatgataaagctagaggggacccactgtgacccacatgctcttggcagcagctggttgcaccacagtctaaggccttcaagcaacttggagggtgacgtgttgcaacctgaactgactcccagcctgcaatgcgagtccctggaagcaccatgggggcaccaggtgaaagggagactttctgaaggggggttcccagccaaaggcctcaaacggtttcctgctaaacggaaacagagcaaaggccacgtgccctccccagctgaatctaccccgggaggactcccctgactttataagccatgaacactcagagcagatgttcaacaggaaggggagggggaagctgtcctaaaaccgtgtgactccgttctaattcagaggaagttttcaaatctgaatttccaagtgggtgttagtttgtatggatcagtgagcccgtcttctttcttgttcttgaaggacagcagattatatctgaaaaaacatcttaacatggactttctttctttctttatttctctctctctctctctttctttctaagttccggggtacatgtgcaggatacgtttttcaatatcttattttaaaaatccacatttgggccacaaaggattaaggcagctgatactttactgtcttgatttttccttaattttatggggttaatcacatgattctttatataccagcaattcttcaccacaaattaataaataagagaacacaagaaggttttgtcttgttccccatctcatgtgttgttgggtaaatggcatgaatttccaatagcccagcatggcattatagtcagggctcagccttggaaaaagtataaaatagatgaagtttgtttttgaggaaccctctgtcctccttgctaaaaactcttttctgttttcatgcttcagatttccttgataagaaaccacccatcaaaatgtattctatccctttagggtcaaacaaatctgagaaaacaaattctaggtataacgtaaatgtttgataagggcttaatgttttattcagtcaagatcctagttgcattttgataagtgtcctgaataccttacttataaggagtgaattacatggaaatttcaggtaagagggaatgattaaagtagaatacttttctgggttttcaatggaaatatatacattacccaagtatatttataaacatcaagggtgggtgtttagaatacactgtgatttgttctaaatcagtattcatattctgcaataaaattttcagaaattctgggtctcatgtaaatgtcttttgactattagagtgttcttggcattaaaactcccacccgcacataaagtgttagacaaacagtccaggattaaaagccagagcattacatggctacattattcattcagtcttacttctgataaatcattcactctttctgagtttcaggatggtaagagcagctccttctactttcttgagtggcaataagaatcaaatgaaatgatagatttgaaagtactttgtaaattataaagcattataataggtaaggaattatcattattatggcattaacttgcagatattttgaaaagggcaataagtgaacagaagctttctgtctaccaacctcatgactctgaacataaaatacaataaacagtggtcaagagtgaacatttgagaggtcagacctgaatttgagctctggccctgtcatttgctagcagtgtgaccctgggcagattacctagcctcatttttttcatctctaaaatggggagaaggagtagtcgctacctctcagagttgttgtgagcataaaatgaaataatgcatttaaaaaatgcttagcagagagtttaatcatatttgccattatttgttcctcttcaatcagaataagctctcagactcctgaaaatgcagccggagagtccacacgagtccctcccacaaaaggccaggtggttagggaaagtcctcaatctctaggtaagctttagagcaactctctaagaggaccctggagcttcatatttcacccagagcaggcagcaggggaagcagctgctaacctaaaggaaaatgttctttccaagtatagagtacctgtgagctgacctgctgagtggcctttcagacacaaccccaaatcaaggtggctctggggagaattatgccggtaaatgaaccaaagaacccacccctttgttttctttaacacagagcagagaataactccatcagaaaggcctcatccaccactcactggggccagaaatcagagaagatgagtaatgttggcctcagggtgtttcctacaagccaagggcctttttagctcaccagtgtggatgaaagtgtgtttcttcatgtctgacttctggtggaacctcttgccacagtactgacaggggtagggccgagtgtctgagtggataagcaggtgtgtggacagtgtggatgacctcttgaagctcttcccacagatcttacagtcaaagctccgttcctgcagagagagagagagagagagagagagagagagagagatgcagaactcctactgcagtcaactagactgctgctctcctcacccctcagctgaccctaaaatcccttgaacactttttctttctttttttgagacagtctcctctgtcgcccaggcttgagtgcagtggaacgatctcagttcactgcaccctccacctcccaggttcaagcaattctcgtgtctcagcctcccaagtagcagggactacaggcacacgccatcacacctgactaatttttgtatttttagtagagatggggtttcaccatgttggtcaggctggtctcaaacacctggcctcaagtgattcgcccacctcggcctctcaaagtattgggattacaggcgtgagccaccgtgcctggcccttcaacactttttctaccaaaacattcttcacccacaaccttccacaccccatggcaaatacatatccacaccctgctttttttgacacccattagcacacacttctccaccctcctcaacaggaggcttagacctcagtcacttgagatgccacctccccccagccagtgtgggtgctgggggagatgggctaatactctttttagccttcgtaagtaggcattctcctgagatagctattggcatatttacttgctcatctactctccatctctcagctaaactataatcttcatgtgggcatgctgtcaaggacctgatgtgttataagattcttaagtacttggcacctggaagttagccaacaaatatttattaatgaatgaatgaataaatagcggcggtggggcatggtggctcacgcctgtaatcccagcactttgggaggcccaggctggtggatcacttgaggccaggagttcgtgaccagcctggctaacgtggcgaaatcccgtctctactaagaacacaaaaattagctgtgctgtagtggcatgcgcctgtaatcccagctacttaggaggctgaggcacgagaatcactttaacctgacagggggaggttgcagtgagctgagattgtgcaactgccctccagcctgggcaacagagccagactctgaaagaaaagaaaagaaaaaagaaaagaaaagaaaggaaggaaggaaagaatgaatagcggggtgaatatgctactagatgctctaaatgagctgagattcctgccttttcagtcgagaggggtcaatgcaaattaagtgacaaccatttggtgaaaagaataggcacaaagaaacagagctagtaagtctgatatatcagcagcacgaatcagtgcatacaaacctacctcaagcccaaagtaacaatgaggatcacactctcgaggctcacagtggtgtgacaccaaaatccagggctgcctcaaggcctgagccggccacaatcctcctttccctacacacctgcaccagggcaaggggacgcagcggagggcttgggggaggaaactgggggaagtcgaggagaaaacttccaggcagagagtggctggtgctgcaccgaggagatgcagaagatccccgagcagggccgcgcgcggcggtgcgccccgcgcttacctgcgagtgcacggctttgtgctgctccaggctcaccgcgtgcccgaaggtcttgccgcacatctcgcaggcaaagggtctggtaccgctgtgggacctgcgcacgtgcacctcgagcccgtgcggcgtggagaacacctaaggcgggtggggccagagagaaggccgctgagaggggccgcggggcgcaggcgaggcgcgggtaggggaagcgggcgcacggcaggcgaggtggtgagctcgggagcctcaccttgctgcacttgatgcacttgtaggagccgccgcccagcagcaggcgggtgcacagcagctccgactccaccttgacgccagcgcccttgtctgcgtgcagcccgtggccacgctcggggtacagcaagcccgccgctgccgtgggcctctcatacagcccggctgccgcagacccgaagtcgccgtagagccctaggccagggccagcggtggcaccggcccctgcgctgcagctccctggcgccccggcccccgcgccgccggcagcccgcttcgggccgtacagcgcggccgggtggccaggctccggggcgggttcgcagaagaggcccaggccagcgccacgctccagggccccacacggtcggtagctctgcaccaggtgccgcaggtcagaacccgccaggccgctccatgagtacggtttgaaaggcagggggaagggctgggcttcgtccagcgatgggcacattgacttctccgaggctgtggaggcacaaggggagcgtccggtcaggcttcagacggcagagcggaggccgccgggctgcggctgcgagcgtggcgtgttcgcggactgcggggcacccagcgcttgtagaacactgcgtgcgccaggtgccaggctcgccccagggtaaaacgtggcccgggccctggggcctcgcaggccactataggaggcagaacagtaaacagatcattgaaaagacctcgggagaggaggtcgtaaattctgtgcgagtgcagcggaggcgctcggcgttccgaggatcttttctggctggacccgcgcacctggagatcctacagggaagggcgcatctataaatgcccgtagttgagctgttaagaaggagaaggtggcggccgttcggcccctcacagcactcaagggcggaagggtccagccaccagcgcaggcactctcccagcccctacatgttcccattcaattctttttcttcccagaatccaagaggaaggagggagaaggtccataaatgcggccccgaactacccgaaaggctgctgtctgaataaacccgaaggtattaagatttcacgaagttaagtgcccagtgtacgtagcaaaggagcagcaggaaaggggcttttgggcttaaattgacagccaaatactccccattcctgttacagtttgatggaggcggggaacctgaatttctcagagaataactataactcataaggtttagccaccacctgcaaggagacagctctgaattctcggcctgctacgcccccacccacgtgaattttgctaaaactagtgaccccaacgcatgtgagtgcatacggcatttacaaatgtgtgtgtgtgtgtgtgcgcacaacactccagttcaggctggccacttcagtgagaggctgtacccggagtttcgttcggaggggttcggggcgcgcccaatccttgtctggccacttgacgccctggcaggaagaatcctcccgccgccggctcccagacacacttgctggagctatggttttcgccaagtcaactcactgattgtgggacgggtggtggtatcttctaaaactagcaaacatattctggatataaccggcccttgacagaatccggctggtctgctcattccttcccccggccgggactcgagacgcccccacccaacgtgtggtcacttagtttgcctgaagctggattgctcgctggaaatgaaacccagagagcaggcccctgaggctaggttaacccggcaaaacgaaaaatgaaacaggcccccaatctgcgcctgtgaagaccaagccgcgggctgagattttcgtcctgccccctccctgccgcccagcgcctagctcctctgcctggcccgttctgccctgttctctgtttgaggtttgggggtctagattgcaggatcctagcactttataaaacagtcaggtctggtcagaaaatgaaaggtcagcgttgccgccagtcgaaacgactggtttgttttccgtcactggccagctccgcgcaaacgaatctaagcgacaagcagctagggtcctgccgcctgggatggaggcagcagccccagcgggcaagctgtccaagtcccagagaagccggatgcctccttcccctacgaatcagctcccttctcccggaaagactctccaactccccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctc

SEQ ID NO: 1731 - DNA, 11311 bp, Homo sapiens
  source 1..11311: mol_type = genomic DNA
taatactcttaatactttattaacttaaaacatcactctaataaatatgtattaacaaacataatgcttaccagaagatctaaaaacatttaccaacctcatcaaagtgaaaataccacctttcccccctctatggtacacatggagggtcaaagagttgaagacagagccttccttcccacatgcctgctagctcagaaatctttaaaatatcagcttaacaataaaaaactgaatatacacacatatctttgaagtaactgttcagctttttgtttacacctgataaaatccaaaagggtcaaaagggaaggtttacaattctgtgctgtcttctcagaattccctccaagagtaagaacagacccagccacttggaggtgcaaccgttagcttttgaggagcagtcaggggttgtgacttcagtctctcttccccaatacctagcatggtgcctggtaccttggtagccggtgatccatgaacatttgctgagtgaatgaatgacatcttgtccacaggcattgcttgtgcttttacctccagtgatgaggttttcacagccctactgaagggaggacctctaatcccctctcattaccaacttctcttctgcttcttcttgggggtagcctcgatggtgcatctcatgacttcaaagtattaaattccttccccaagtcagtttctgaatcagtttttgaggaggagaaatgattcctccaagatttataggcagcacccaaaagaaaggagtcaacagaccccccagaaggaaaaaaataaaagttaacactcactcttctttctagataaaaatattagcatttgtccaccttgtaaatggtgattcctcctcttccacacaaatatctggggtaggtcaagaggggggagggaagaaacctgaagggcattcctgtctgtagattagggctggaaatgggaaggactgtggggtctaagatttattctggtccccatttgactttgcctttgtcttcaggtgtagaggagcctatttgtgtccgaagcctagagagtcacttggttctcactctcggctgcactttgaaaaggtacctcatttcttctggcagctccaggaggtaaggcgaaggaggagcaacctggtaggatctgcagactggacctggggtctggaaagtcagaagggagtggaggcaagcagggagcagagtggtggcaagcagggaggctgccctctgtagtgttgtgtagctgctgcttgcagccagccagggtgctcatttgagcccatgctgcgtctcccggtgccttcggaggtccaccttcctctggaaacccttcccacagaggtcgcagccgaagggcttgaagcctgtgtgtttgcggctgtgggtgatgaggttggagctctggctgaatgccttgccgcacacctggcacttgtgaggcttctcacctgtggggatgggagggggaggggagaaagtatgagtctatgataaagctagaggggacccactgtgacccacatgctcttggcagcagctggttgcaccacagtctaaggccttcaagcaacttggagggtgacgtgttgcaacctgaactgactcccagcctgcaatgcgagtccctggaagcaccatgggggcaccaggtgaaagggagactttctgaaggggggttcccagccaaaggcctcaaacggtttcctgctaaacggaaacagagcaaaggccacgtgccctccccagctgaatctaccccgggaggactcccctgactttataagccatgaacactcagagcagatgttcaacaggaaggggagggggaagctgtcctaaaaccgtgtgactccgttctaattcagaggaagttttcaaatctgaatttccaagtgggtgttagtttgtatggatcagtgagcccgtcttctttcttgttcttgaaggacagcagattatatctgaaaaaacatcttaacatggactttctttctttctttatttctctctctctctctctttctttctaagttccggggtacatgtgcaggatacgtttttcaatatcttattttaaaaatccacatttgggccacaaaggattaaggcagctgatactttactgtcttgatttttccttaattttatggggttaatcacatgattctttatataccagcaattcttcaccacaaattaataaataagagaacacaagaaggttttgtcttgttccccatctcatgtgttgttgggtaaatggcatgaatttccaatagcccagcatggcattatagtcagggctcagccttggaaaaagtataaaatagatgaagtttgtttttgaggaaccctctgtcctccttgctaaaaactcttttctgttttcatgcttcagatttccttgataagaaaccacccatcaaaatgtattctatccctttagggtcaaacaaatctgagaaaacaaattctaggtataacgtaaatgtttgataagggcttaatgttttattcagtcaagatcctagttgcattttgataagtgtcctgaataccttacttataaggagtgaattacatggaaatttcaggtaagagggaatgattaaagtagaatacttttctgggttttcaatggaaatatatacattacccaagtatatttataaacatcaagggtgggtgtttagaatacactgtgatttgttctaaatcagtattcatattctgcaataaaattttcagaaattctgggtctcatgtaaatgtcttttgactattagagtgttcttggcattaaaactcccacccgcacataaagtgttagacaaacagtccaggattaaaagccagagcattacatggctacattattcattcagtcttacttctgataaatcattcactctttctgagtttcaggatggtaagagcagctccttctactttcttgagtggcaataagaatcaaatgaaatgatagatttgaaagtactttgtaaattataaagcattataataggtaaggaattatcattattatggcattaacttgcagatattttgaaaagggcaataagtgaacagaagctttctgtctaccaacctcatgactctgaacataaaatacaataaacagtggtcaagagtgaacatttgagaggtcagacctgaatttgagctctggccctgtcatttgctagcagtgtgaccctgggcagattacctagcctcatttttttcatctctaaaatggggagaaggagtagtcgctacctctcagagttgttgtgagcataaaatgaaataatgcatttaaaaaatgcttagcagagagtttaatcatatttgccattatttgttcctcttcaatcagaataagctctcagactcctgaaaatgcagccggagagtccacacgagtccctcccacaaaaggccaggtggttagggaaagtcctcaatctctaggtaagctttagagcaactctctaagaggaccctggagcttcatatttcacccagagcaggcagcaggggaagcagctgctaacctaaaggaaaatgttctttccaagtatagagtacctgtgagctgacctgctgagtggcctttcagacacaaccccaaatcaaggtggctctggggagaattatgccggtaaatgaaccaaagaacccacccctttgttttctttaacacagagcagagaataactccatcagaaaggcctcatccaccactcactggggccagaaatcagagaagatgagtaatgttggcctcagggtgtttcctacaagccaagggcctttttagctcaccagtgtggatgaaagtgtgtttcttcatgtctgacttctggtggaacctcttgccacagtactgacaggggtagggccgagtgtctgagtggataagcaggtgtgtggacagtgtggatgacctcttgaagctcttcccacagatcttacagtcaaagctccgttcctgcagagagagagagagagagagagagagagagagagagatgcagaactcctactgcagtcaactagactgctgctctcctcacccctcagctgaccctaaaatcccttgaacactttttctttctttttttgagacagtctcctctgtcgcccaggcttgagtgcagtggaacgatctcagttcactgcaccctccacctcccaggttcaagcaattctcgtgtctcagcctcccaagtagcagggactacaggcacacgccatcacacctgactaatttttgtatttttagtagagatggggtttcaccatgttggtcaggctggtctcaaacacctggcctcaagtgattcgcccacctcggcctctcaaagtattgggattacaggcgtgagccaccgtgcctggcccttcaacactttttctaccaaaacattcttcacccacaaccttccacaccccatggcaaatacatatccacaccctgctttttttgacacccattagcacacacttctccaccctcctcaacaggaggcttagacctcagtcacttgagatgccacctccccccagccagtgtgggtgctgggggagatgggctaatactctttttagccttcgtaagtaggcattctcctgagatagctattggcatatttacttgctcatctactctccatctctcagctaaactataatcttcatgtgggcatgctgtcaaggacctgatgtgttataagattcttaagtacttggcacctggaagttagccaacaaatatttattaatgaatgaatgaataaatagcggcggtggggcatggtggctcacgcctgtaatcccagcactttgggaggcccaggctggtggatcacttgaggccaggagttcgtgaccagcctggctaacgtggcgaaatcccgtctctactaagaacacaaaaattagctgtgctgtagtggcatgcgcctgtaatcccagctacttaggaggctgaggcacgagaatcactttaacctgacagggggaggttgcagtgagctgagattgtgcaactgccctccagcctgggcaacagagccagactctgaaagaaaagaaaagaaaaaagaaaagaaaagaaaggaaggaaggaaagaatgaatagcggggtgaatatgctactagatgctctaaatgagctgagattcctgccttttcagtcgagaggggtcaatgcaaattaagtgacaaccatttggtgaaaagaataggcacaaagaaacagagctagtaagtctgatatatcagcagcacgaatcagtgcatacaaacctacctcaagcccaaagtaacaatgaggatcacactctcgaggctcacagtggtgtgacaccaaaatccagggctgcctcaaggcctgagccggccacaatcctcctttccctacacacctgcaccagggcaaggggacgcagcggagggcttgggggaggaaactgggggaagtcgaggagaaaacttccaggcagagagtggctggtgctgcaccgaggagatgcagaagatccccgagcagggccgcgcgcggcggtgcgccccgcgcttacctgcgagtgcacggctttgtgctgctccaggctcaccgcgtgcccgaaggtcttgccgcacatctcgcaggcaaagggtctggtaccgctgtgggacctgcgcacgtgcacctcgagcccgtgcggcgtggagaacacctaaggcgggtggggccagagagaaggccgctgagaggggccgcggggcgcaggcgaggcgcgggtaggggaagcgggcgcacggcaggcgaggtggtgagctcgggagcctcaccttgctgcacttgatgcacttgtaggagccgccgcccagcagcaggcgggtgcacagcagctccgactccaccttgacgccagcgcccttgtctgcgtgcagcccgtggccacgctcggggtacagcaagcccgccgctgccgtgggcctctcatacagcccggctgccgcagacccgaagtcgccgtagagccctaggccagggccagcggtggcaccggcccctgcgctgcagctccctggcgccccggcccccgcgccgccggcagcccgcttcgggccgtacagcgcggccgggtggccaggctccggggcgggttcgcagaagaggcccaggccagcgccacgctccagggccccacacggtcggtagctctgcaccaggtgccgcaggtcagaacccgccaggccgctccatgagtacggtttgaaaggcagggggaagggctgggcttcgtccagcgatgggcacattgacttctccgaggctgtggaggcacaaggggagcgtccggtcaggcttcagacggcagagcggaggccgccgggctgcggctgcgagcgtggcgtgttcgcggactgcggggcacccagcgcttgtagaacactgcgtgcgccaggtgccaggctcgccccagggtaaaacgtggcccgggccctggggcctcgcaggccactataggaggcagaacagtaaacagatcattgaaaagacctcgggagaggaggtcgtaaattctgtgcgagtgcagcggaggcgctcggcgttccgaggatcttttctggctggacccgcgcacctggagatcctacagggaagggcgcatctataaatgcccgtagttgagctgttaagaaggagaaggtggcggccgttcggcccctcacagcactcaagggcggaagggtccagccaccagcgcaggcactctcccagcccctacatgttcccattcaattctttttcttcccagaatccaagaggaaggagggagaaggtccataaatgcggccccgaactacccgaaaggctgctgtctgaataaacccgaaggtattaagatttcacgaagttaagtgcccagtgtacgtagcaaaggagcagcaggaaaggggcttttgggcttaaattgacagccaaatactccccattcctgttacagtttgatggaggcggggaacctgaatttctcagagaataactataactcataaggtttagccaccacctgcaaggagacagctctgaattctcggcctgctacgcccccacccacgtgaattttgctaaaactagtgaccccaacgcatgtgagtgcatacggcatttacaaatgtgtgtgtgtgtgtgtgcgcacaacactccagttcaggctggccacttcagtgagaggctgtacccggagtttcgttcggaggggttcggggcgcgcccaatccttgtctggccacttgacgccctggcaggaagaatcctcccgccgccggctcccagacacacttgctggagctatggttttcgccaagtcaactcactgattgtgggacgggtggtggtatcttctaaaactagcaaacatattctggatataaccggcccttgacagaatccggctggtctgctcattccttcccccggccgggactcgagacgcccccacccaacgtgtggtcacttagtttgcctgaagctggattgctcgctggaaatgaaacccagagagcaggcccctgaggctaggttaacccggcaaaacgaaaaatgaaacaggcccccaatctgcgcctgtgaagaccaagccgcgggctgagattttcgtcctgccccctccctgccgcccagcgcctagctcctctgcctggcccgttctgccctgttctctgtttgaggtttgggggtctagattgcaggatcctagcactttataaaacagtcaggtctggtcagaaaatgaaaggtcagcgttgccgccagtcgaaacgactggtttgttttccgtcactggccagctccgcgcaaacgaatctaagcgacaagcagctagggtcctgccgcctgggatggaggcagcagccccagcgggcaagctgtccaagtcccagagaagccggatgcctccttcccctacgaatcagctcccttctcccggaaagactctccaactccccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctcagcggtaaaacctgtcccggggccctgtctcaggcccctttcctcctccctgcccacgccccccagctcctcccctttcctagcgaagctcgctccggcaatcaaactccctggagagctgtagttcccatcgggtgggttaccccaactcagctactcatcgcctgcctggctgtgctttacggctggcgagggagggcggggacacgcggatcggtttaggggccggggatgcccagtggtcgaggacccggaaggggcaaggagccaagacctccaagagccagctaccaactggagtgaaaggaccggggggaggggggaacagaacacaagataaaactgtggggcggcgggaggacagcagcagagggattggggacagcagaggccagagaaaggaggtgggagagcaaagggacaggaaagtgaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagctgcccggggcgtcgctctcattaacccccaatcagttcacctaataccaggtcgaaatctgagcgcagcgggagggcgtggctgcgcctgccgctaggctccagccggctccgggggcggtaccccacagtcgaggtggtctggagtaaacgaatctgccttcctcccggggtgaaggcgatggtgaccgggttcacacgtgagctgcagtacagcagttctccgtggcctcggctggttcagaaacgagggtgctgggaactctgggccggggcaggacctgcagtcctccggcttcgcgctgtttccactgccggactaggagcccctcggcttcctaggcaagatgcaggccacacagtctacgtctgtccgttggcgctctcagctcaaacgagtcctacaggccttggtccctgtagggtgcaggccccctgctccagatccccagccccattgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgcttt

SEQ ID NO: 1732 - DNA, 86569 bp, Homo sapiens
  source 1..86569: mol_type = genomic DNA
tcttcattctgaaaataattttattattttacagttgttcaggaaacttcccaggatgttgtaaccaagatttaatcaccacagtagatttagagcagatcagtcagcccacttgtcttctctcttctttagggagaggctaggcagtgaacacatcacgtatgcaatgagaaaataaccaactggtaggatgggggaggggaggggaggcagggaataggcacaaatggaattctatcctggctgtccttctcaggtctatctatatttaattttgtcttctctatattctccttccattgccacagagggcagagacaatggggctgagaaactgtaataactgtcactaacagcaaagtagcttagtacttcaagaggtcaggagttgcagtgtggtgttagaccagtcagactcctggctgagagtcaatgcctaatattggctcccagtggcccctgagcactgtctcagggtccacattccaggaatattcagatattcctggaatgacaagaattggaaccctgctgtccatagacacttctccctgccctttggtgaaaggaaagacttgggccacttaataccttagtatacatgtgatcaagggcaaaagcaaagggattctatccttatagtctaagacctgaaattctccctccaattatatctgaaattggcagggaagaagatgctgtcctcccatgtgatctaacagctaaaacccctagggagttccttcagctttcaccaccctattctgcaagagacctaaatcagatgtcctatgaggtgacatgttcatttccctgaactctgtttatggcagagccaccttccccctgaaacaggagaaaatacaggcaaacaaggcaaagaaagttatcaatcaaaatgatactgaacttcagattattaggtttattgaaaccatcctcttggcttggctgaaagacattcctcagtatcttttacaggaccacaaaagatcagggtcctgcaaaatctcaacaaatattaggctcaacaaaccaaatgtgattctcagattaagcagaagcgttcaggctcagggcagtagaagaaagcagactcgccagtccctgcagctccaacctgtcctcgtatccacctctgtttttgcaggcactttccgtgaagagttggagagaagacctgtaaatgggaagactgttccactggaattgatgttctgatgttagaggtgagagaattccaagttttgaggggagtggtccaaagagtaacaactaagtctatagatggcccgtaaaacacagaatgagcaggacatgaatcattagaaagtagatggctgctagaagtggcactcgggtccgtgaatgacagagtgaacgcaggactcgcttccatccaacgccactccgggtctgaaagaaaaatgtgaaagtcagagagttttcaccctatagggctatgttgctttccctcctactagtcttgcacttaagcaaagctgacccaaccactgtagaaaggggtattctgagaggaaagttgcctcagagtcaacaacttggcaaattccaccaggttctaatcttccacgcccttccagccttagactcattcgctgctcagtggctggacttccacattccttctcctcagctccttgcccccagtatagccagccctgtcagataataaaacaccctctctttatccttcttcctcttacccttcgacaactgttgcttgtaagatctattaacagtgcctgctcctgagtgccacaggagccaatgataggagtccgggaagagtcccattcactgtgctctaacctgagttgagaaaaaaaagaggcatagcattggttcatagcatgagaggctgatcaggcccagtcttcccagtcatcctgccacacaatgcagcacaggaggagacttgcagcaaaagctgctcccataaacccaaacccatgcaaggggggtaccagcagatacgtttccttcagcagcagcaaaatgtgacaataactatcaggaattgactgcctactcactatgtatcaggctctaggctgggtgctttacatacatttaatcctcaggttctgaggttggtcttattatcttcaaagtgctaaggcttacagaggttaaattacttgcccatggcggcacagccagtaagcggcagagccagaattcaatacccaactttgtctttcaagcctcacgttcttttttccaccacaccacacctgacttggagaaactcattacatttttttcttttattaaaggctaataggcaaaagcatccaaagaagatttctgtggggttttaaaaattaaattgaactaaaaaaaattaaattgaattggcagtctccactgccttctggctcagtttttgctgatttgcttatttaatactggaacttctccatttaatgaagaagctgccattactcactcaatggttatgtcaaacaaacaaaggagctgcatgtaacacagcacgtttgatcaagcatttgcctatagggatgaactttttcaatagggaagagaggatgaaactcttgcctctactctttgtgttttctccttctgaaaggatatctattagtttaatattcttgggctctctgcaggacacattcttttccccgggagagaagaaacaccttaatccaatttgtgagtctagaaagagaactgagcatgcacagcctagctccttctttcctgcttccctcctgagagccaggctgactaaaaaatacaccttctgtgtctattcctccatgtgataagcttttcagaagcagctttgatctggaacagcatggtctgttactatggaggtcagtctgtcaatgtaggctatgctgaggaaggatgagaagtctgtaggtattgatgaggaagatggtactggctgcctttaaactggagggccactgagttccacctgctctttagagtacatgtgagattctaacattacaatggcagtacctggactaggcaggcagcccttaattagctaccccaacttccattctgcatcagagctaaagagggaattgtggcttgaattaatacggcttgcccacaggctcaagagtcatcatcccacacatgcagtctcagttggtttgggacaggttagttacacaagagggagatcaacctccccattggccaggtttcaccggtctaaacaattcaatagcaagtagaagagaaacagtcatgagggcacaggcctgaaaatgctcggcagagatggcaagacaccacacaaggcattaagcaaagctggcccaccctcaaagctgcatatcaaggcctgaataggtgatgaaaattaagaagttgtgaatatgttggattggaaagaaaggtatctcaagtaagacctgctcaatggggctgtcacctctgccacataaactttacaagaaagcattaatatcagaaatgtcattctctgaggaaagtgatcatatacataggtggctttctcccaaaatataataaaagtgcctgcttttaacgatattttccgtggaaagggacttccagcagcaaaatacttgtagcaactctctatcctctcatgcatagtgattcttttgatgagaataaggaactagggatgtgtagctctgcccttccaaattacacttggagcaaactgctcataggaagcacagttcactctgttattccaatactcttgtttggcaagagcaggattttctgtgaaggaggtctaccttggcccaacattgtctgtgactgggaggggaagttcagggttaggaagtgcatttgccaacaaataaaaagctacattcttttaacatcatttataaagcagtcttttaatctctcaatcttttaatcttttaaaaaagatttccatggattcagatctcaggtagaaaatgaggttgtcacttatttggtcctctagagaacccaacacctacctcatatagttatggttagggtgaaataaaatatctttcagtaatggtagatatcattattattctctaagaacaactgttttagaaaacactgactctcttatactccaaaagtacagtgttctcttgggtgaccacaatgttggtaaactcattgcagcaactacctcaagatgagaaaaagatcttaagaaatcctaagtctggcaggaaatgtacatgagtttgatcagaaaggatcggaagggaacagaggctatctccttcagcctttaccgtctgatctgctcctcggccacagagagagcattctcagcagccactctttggtctcgttcttcttccagcagcttccttaattcattcacttcctgtctggtgttgcatagctgctgctgagcttcagaaaagctttaggatgagaggaaaacaaaaagcatcatcagatgcagaaaacagttgctaatacaagggattcaaagtcttcataaggttgtaaagcaagaaaatccatagaagcttgtctaaacacaatattttaaaagcaaagctgtagagggattaaatgaagctgcagaaaatacctaaagaaatttcaggaactgattatctttcattttactatcatagagtagttgttagtggtgtgtgtgtgttggtgttgctctttttgttttacaaacttttcacacacaaatgttagttattattgttactatttgatcctcacatcacttctgtgaggctaataagataacaagacatattaaatccatataaaggactccagttaaatctagattactgcccaatttctggactctggtgtatgctccagggtttagagagccactcccctacctttgctgcggttcccttagttcctcagggtcactctttctgtgaactccattcttttcctggggagctcctggagcaacatctatatttagtggcccctggaagaagaataagcttagtaattcagtgatgaaagctcttaagaaagtgtatttgagcaaaatgagagctcgtttacagaggactatccccgcttataattctcaagtccaaatttagaagtgagaagcttctgctctagcagattactcacctacataaaactcttgtcttgattagatttttctcccagattctcattcttgaatttctcctcttaaaagttaagtctgggccgggcgccgtggctcaagcctgtaatcccagcactttgggaggccgaggtgggtggatcacaagatcaggagttcaagaccagcctggccaagatggtgaaaccctgtctccactaaaaatacaaaaaattagccgggtgtggtggcaggcgcctgtaatcccagcaactcgggaggctgaggcagagaattgcttgaacccaggaggtggaggttgcagtgagccgagatcgtgctactgcattccagcctgggcgacagagcgagactccgtctcaaaaaaaaaaaaaaaaaaaaaaaagttaagtctgctgtggatgcttatggcttttccagaagccactttgatccttcccttgcttgtccagcccctcccaacccccttttcctcctccgtatcctatacgtctccatactaattctcagtctcctccaacttcaatgctgtactcctctccctggctgtcaacagtgctgcctgttttgttctcagatccaaagtttcctacaattttcttataacttaaagcaaaatcaacactttctctgtttcagagtaccaaatgtctcagtcatcactgtttcctactcatgttttgatttctctcccaccatctcactgatcttttttcttctaattgcttcactgtaatttttctcagaccttattcccatctcaattaactctttcttctctcccactttcttccctgacccctaattacattaacttcttccatactgctctgtagtgcttcaccacttgcactaaatttcatcacacttctcccagtctctcaccttctctttactcaccgcctgcagctcttgaacctgcttctccaagactgcacagtgatttaaaaggtcaccatagtgctgctggttctcacgaagactctgactggtatcgcagagctgaatggaaagggtgtttttctcttccagtagctgagagaactgaaacagaggcgaggataagcatcatcctgcagtactgtaagcagtgctgaggtgaaatgttctgagttttcaggatctaattttcctatggaagacctttgtttcagcaacagcaacaatagcactttgtgtgccttcaaagttggaaaaagcataatttttttttgaccaagacagaaaacaattctggaggagtagcagaaaggtttttttgttttgttctgttttgtttttttaaatggtgcccagtacattaactgaaaaaccatgaagcagaagtccataagcaatctaattacataggctattctgggtacataagagggagaaggcagtacctcagggtcaaagttcatggtactaacaaatgactataatctccagaactcaatatggctggagagagctgtcaccccaaaatctgtgcaataatattcctaggcagattcctcaatgccataaagagttataagttactgagagaatagaataaaaaattataatatgtggtagaagggagaaacagaataaatcccaacatgtatatgtatatgtcagaaactgttgagagcatagattctcccaggtagaaacatttcagtcccttaaagcaggactctcctctactgcatgactaacaggtcatcgttcagtcttcccttgaacatgttcagtgtcagggcgcccactgcctgacaaagcaacccaaaccatttaaaaaactgaaaattcatttttatattgaatgaaaaatttacctattgtagcttctacccattgatttgaatttggtactctggaactataattctctcacttgcaggctgtcaagttttaagttttagctgtgattagcctccaggtacattaataaccatggagatgtctctccaagttatctactctaggaccatgtacattatatgagaggaacccagtataccagttgcatgttcaattttttcttgatgattcttttttgtaagtttttgtgaaaaaaagttgaaacaaacaatgttttagaggagagacgacagttttctagagacaactgtgaggaagggcatttgatgcaaatagaaaattagaacaagataatccatacatacttgtaaaagtgctctgttagctgaaaattgctcttcagatgtagggttgttttttgtgtttgtcattctgaagagcaatgttagcttacaaagtactttcaccagtatcatcttatttgagagaggtagagaaaggatttctgtccttgtttacaaatggctagtagatgtcaaaccaggactcaagtgtggttcttgattccaagtctagagctctatctactatctgatggtgtccagtctgatagtctagcaaggaaagctaagaaaatcatagggttttcttttgggggggggggtgtgggaggaggtgggaatagttaggaaaggatataaatatttgggaagtgatactaatttgaagacagttaactgggtacaatgacaactattggattctgagacagggcacaacatgttcttcccttaacctaagaggaagttaattttcctggccacaatgaacagtccaaaccataccaaaaacaaaaacatagatccttctagtttaggggttggcaaactatgatccagggcctgctgcccttttatcataaataaggttttactggaacacaaccagcccaattgattctatattgtctatggctgcgtttgtgttacaactgcaaagatgagtagttgttaacaaagaccatacagtcaacaaacctaaaatattgtctgagcctgaaggaaaagtttgctgacctctcctctagcttataagctactatatttcactgtatctatacctgtaaaaacaaaataggagggaacaatttagactacattatgtcactaatcatccatctcatgtttttaagtttctagcacattcttacattacatactaacatccaaacagctggtagaaatgcagtcatcccttgttatctatggggtattggtttcagaaccacccctggacccccaactcccagtataccaaaattcgaggacgctcaaattccttatatataatggcagggtatttgcatataacttatacacaacctcccagatacttaaaaaattttttaattcatgtataatagatatacatagtttcaggatacatgctataatgtaatatattcatataatttgtaaagatcaaatcagtgtatctggaatatccatcaccttaagtatttgtctttcctttacgctagaagcatttaaattcttctcttctagctattttgaaatatacaatagattgtggtaaactataatcacctattgatttacctaacactaggtcttatttcttctatcaaaccatgtatttgcacccattaatcaacttctcttcattccctcctctcctttatccttcccagcctttagtaactaccaatgcactctctatcttcatgagattcacttttttttttttgctcccacacgagtgagaatgtgatatttgtctttctgttcttggcttatttcacttaacataatgtcctccagttccatctatgttgccacaaatgacagaatttcatacctctaaaagctgaataatattcccttgtgtacatataccacattcttaatctattcatctgttgacgggtacttacattgattctatgttttgttttttatgaacagtgctccaataaacatgggagtacagatgtctttttgatatattgattttctttcttgtagatacgtgggttgctggatcatatggtagttctatttttagctttttgagatacctccatactgttctccacagtggctgtactaacttacattgctaacagtgtatgggagttccccctttctctgcatccttgccagaatctgttactacctgtctttttgataaaagctatttcagcaaaggtgagatgacatctcactatagctttgatttacaattctctgatgtttagggatgctgagtatttttttttatatctgttggccatttgtatgtcttcttttgagaaacgtctattcagatcttttgcccacttttaagttgagttatttgttttcctgctatttaattgtttgagtcccttatatattctggttattaatcccttgttagatgggtagtttgcaaatgttttctctcattctgtggattgtctcttcactctgttgattgcttcctttgctgaacagaagccttttacttgctgtaatcccatttgtctatttttgccttggttgcctgtactcttcaggacttacacaaaaaaagccttggctagatccatgtcctgaagcatttccacaagttttgctctagtagtttcatagtttcagatcttagaattaagtctttaatccattttgatttgatttttgtatgatgagagataggagtctagttttatttttctgcatatagatatccagttttcccagcaccatttattagagagattgtcctttctccatcatatgttcttggtgcctttgtcaaagacaagttgcccctaaatgcctggctttatacctgggtttctaattgtttcattggtggtctgtgtgtctgtttttatgccagtatcatgctcattaaacaggtagtgtgatgcttccagctttgttttgtgtgtttttttgttttttggttttttttttttttgagacggagtctcgctctgtcacccaggctggagtgcagtggcgcgatctcggctcactgtaacttccacctcccgggttcaagcaattctctgcctcagtctcccaagtagctgggattacaggcccccgccatcacgcccagctaatttttgtatttttagtagagacggggtttcaccatgttggccaggatggtctcgaactcctgacctcaggtgatccactcatcttggcttcccaaagtgctgggattacaggcataagccaccacactcgacccagttttcctctttttaatcaagattgctttggctagttaggagtttttgtggttacatacatattaaattttttttcccatttttgtgaagaatgtcattggtattttgatagggattgcatttaatctgtagattgctttgtgtagtactgtcattttaatgatattaattcttctaatccatgagcacgaaatatctttcctttttttagtgtcctcttcaatttctttcacagtgttttataaatctttcatttctttggttaaattgattcctaagtattttaaattctttgtagctattataaatgggattgctatctatctatctatctatctatctatctatctatctatctatctatttttgaaacacagtctcgctctgtcacctaggctggagtgcaggggtgcgatctcagctcactgcaacctccgcctcccaagttcaagtgattcacatgcctcagccacccgagtagctgggattacaggcgtgcaccaccatggctggctaatttttgtatttttagtagagaagggatttcgccatgttggcaagactggtctcaaactcctggcctcaagtgatccactcaccttggcctcccaaagtgcaaggattacaggcatgagccaccatggctgactgggattgctttcttgatttcttttccagattgtttgctgttggcatatataaatgctactgatttttgcctgttgattttgtctcctgcaactttactgaattcatttatcagttctaacagttttttggtggattctttaggtttttctaagtataaggtcatatcatctgcaaaaaaggctaatttgacctcttcctttccaatctggatgtgcttttttttttgttttgtttttgcctaattgctctagctagggtatctaataatatattgaataacagtggtgaaagtaggcatccttgtcttatttcagatcttagaggaaaggccttcaatttttccctgttcagtacaatgttacctgtggcctcccatatactttaaataatctctagattacttataatacctaatacaatacaaatgctatataaatagttgttatactgtatttttaaaattcatgttttcctgaatattttcaatctacagttagttaaatctgtgaatgcagaaattaccaatatgaagggccaactataaatataaaacctgaacatctgaagaaagaattagggaagtggcttagagaagaacaatctatgctgacagcccatctactacaatctcattctggggcccaagaagcaattctcctatttagctgggactcattcagagtgaggctaagctcatgaaggaatatgtatatcctcagtatctagcatatagccaggctcatggaagacaaataatagttattgttttaatgactgaataaggctaggaatgaggtgcctttctttttttttttttttttttttgagacggagtctcgctctgtcgcccaggccggactgcggactgcagtggcgcaatctcggctcactgcaagctccgcttcccgggttcacgctattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctgaggtgcctttcttacagttgagttctaaaggaaaaactgtttctcactcagaatgacagtgacctatgcagtgtttctcacactttaagtggaattacatatctcaataaaggtgttaaaaaacacaactttatgacttagaacccagtatataaatatatacaattaaaactaaagttttccaaagacagacatattctttattatatattacatacgtgtttttacctcatttcttttttttgtaaaaacaccaactgcactatttgtaatagccccaaactggagaagcccaaatgtccttcaacagaatagagattgtggtatatgcctaaaatgcaatactacacagcatgagagtggaaaaatgacactatatgcaacgacatggatgaatctcacaaaataaatgaagcaatataaaagaaaaggtatgactccatttatatgtagttctaagtgggtaggagtgaacagaagacacaagggacttctggagttctggtatgttctgattctagatctgggtgctgattatatgggtatcttcactttgtgaaaatatatcatgctgtacttatgatttgtttacttttctgtatgttttacttcaataaaacattaaaaattttttttagttgttgcccaccaaaatgatttcatcatttattaatggtcctgaatttcagtttaaaacactgtcctagacagacaaatgcccaatgtgattcagagtctaatgtttggagagcaaatgtaacaggcctgagacgggagttagttgacggaaaaaagagacaggctagagctgtaaagggtggaacttccggaaatagctgatttgctggaaggggaactccatgggagctgctctggagtccctttgaaaactcccagacaaatctaccaataaagagtctacagtttaactaattcatttgggcctgcagactttaaaaactgcaaatgtctcctctctgatacttcagtgtcaattagttgaatttaactacatttaataagtaccctctacatatgcaggcactgtgcttttccacatgcatgatcacgtttatttcagactgacttcgtcctaacacctcaggcaagttacttactactccagggcctttttcctcatctgtgaaaacagcctagtgatctttttaatttttggatcacagaccccttggtcaactgatgagttcttgtgatgaaaagcttacgcacacacacactattgtgcatacaatttttgggcattcttggctctcctcaaagctaatctctggacttctgattctgattgatctctaaatatcttgtagttctatcatagactacttagctgagttcctctcaagagggcagaactagggcaggtgccactaaagaatattttgaatagtcagtgaacaacaggaggacaattcttaagagggtggggtagggagtagcctcagcattactacaagtgatacaggtcagggggaaggcttcctaaagtagttggcttctttacttttactgtctggatttatccaatcattcccaaggactcaccaagggcaaaggacaagaaatggccctgtgtccagtgctttggaataagcacccaggttctgagaaaggtgaaacttctgtaccctaagatatgctacagctgggactctatgctgaattggcttctacttgccttcttgttccagtcatggaaaaaagaaactgaattccagtctaacaagaaacacttacgttgctgttcagttgctgaattcttaactccttttggtgaatttcctttaagctgtcattgagctgggtcctgagaagttctgtctcataaaccagattttgtgacccatctggggaagctgatgtctctggggatgcctgccaggacacaaacattgatcagattctctcctaagattgcgcatgcttaattccttccctctagaaatcctgtccgccccatagaagtcataaggtggcttatgggcacttaatagtggcagatgggcacttaatttgtaggaagctgatgctttctgggtagcgtcttaaaaaaaaaacaaaaccctgcaatcatcatcatttgtttaaaaatttatctctgagtaacaatcagcattgaaattactcacctgtctttggtattgcactttgagaggctgagtctgggaggaagaagacctcaattcccttataagattctgcagatgactgagctgctgatctttatctgagatagccataaggtactgttccttcattctcctctcatgtatttcccaggaactcttctccatcctagaaaaaacatgacacaatcacaggtaaaaatatacttgtaactgggcatggtagctcgcacctgtaacctcagcactttgcttatcttcaaagttactcaaatctggaaggtaaagaaagaaaggctaagaaaaaggtggaaagagagaaaatgtgggggaaaaaacaggaatctttttttctctatctccttttctcttccctaagggtcaattatataaggaaataaggaaaataaatatccttttagattgccattagaggaaatttaaagaagaaaggctgcaggaaataagcctttagagctttgcagctcttcttaggtttacactagtagctgaacactttaatatttctgtagttctaggtgatgtggagataagatgagaggcatcaagcgatgctctgatacggtaccaatcacctttggagggccctaaattcaagtgcatctgaaggacacagcaagcacctaaacttctgatgataaattaagattctaacagaataaagctggggtgctattccctgaagaaaaatggaggttaaaatggagcaatttatcttttctcttgagattcaatttcaaaagaagaaacaaatttatatttctagagagcaaaactcagttgttttgccattttctttttacttgctctgcaatcatcatcatttgtttaaacaaaaaatttgttcttgtattatctggggaagctgccaactccatgcaatgagcttgataaatgttcacttataatcaagtccataaagatgttaaatatgaaaatcttttagatgtaattttactccataaagtttaaatcattaaattccaaaaagcattttgctatatcaatgttgcttaaggtttgaaatctcctgtgtctgaacattaagaactctcttagagatgttatgatatttatactatattgacagttgtcattctaatggccccttgtaagctggatagaaattgagattccaactcatattttctgtattcatttgcctcttgtcctctagcattggtgaaacaaagcaggtgctgcttgatcagcagcaatgtccaacatggtaattctccttttaatatcaaatcttgaaagctttttgaattttttttttttttgaaacagggtctcactctgttgcccaggttagagtgcagtggcatgatgttggctcactgcaacctccacctcccgggttcaagcaattctcctgcctcagtctcccaagcagctgggattacaggcgcacgccaccatgcccagctaatttttgtatttttggtagagatggccaggctggtctcaaactcctgacctcacatgatctacctgccttggcctcccaaagtgctaggattacaggtgtgagccaccgcacccagccaagtatgaatttattaaggcagcatgaaccatcttaagttaaacagtaacaacctcccaaaaatgaggctgcaacaactagacctgtttttatacactaagtgtttaatcttgggattaaatttgtcagaaaaactgaattaaaaaaaaaatcagaattatagctcctatcttaatttcttctgccatgatagcattattattgttctgttccttaaaaagaaaagagctaggatttctggttctagacaaaataaaatagacacatttctccttattcttccaactaaggctgagcaaccctaatcagaaaatcagaaatacttcaaaatccaaaactttttgagcactgacatgacactcaaaggaaatgctcattagataatgcaaatattccaaaatccaaaaaaatccgcaatccaaaacacttccaatcccaagcatttcagataaggaatacttaacctgcatagataaaactcttgggccttataaataaaaacaaacataagaaaatttagaaagatggtggcaaaccagctagggatccccagacttgaggaatgacatggtggcaagttctttggtttaccatttgtattctgcatatcccaaaccggatactggagaattccatgacccggaaacaccaatgagtaccaagtttactcagtcttgccaaaggaccaggaagggacagtctagctagacagagccattaatgatactaaccaccatactccaggcaaacaacatggaaaaaacacagtatctcaccactcccattaacaaagacctggtagataagctaggtacattcttggctggtggtaacaaggtacacctcaccctccttactggagtagtgtcagaaaaggccaggtatggagcttggactcttacaatcacctagtgctaagaaggtgcctctctccgactgcccctcctcccccactcccactgtggtatcagtggaggcaacatgtggggcctggacatccccctccaccataacaaggttaataaggcactcttccttgtccctgcagaggtggtatcagaagagatcaagtggggattctggactttgagtactacccagtggtaacaagatgcccctcttaaccattccccatagtgtcagtggaggctaagcggatagcctggacttttaccaccacctggcaataatgaggtgcccctctccactccttccagcacagtatcaatggaggccatgtggggagcatggacttccacttcctcctggcagtatcagggcatcccttccttttaggggtatcaacgaaagttgaatggggtgcctggagttcaccatccacctagtgtcttccttcccctgccggtgtggtgtcagtgaagcctgctaacacagaagattcaaataagactgaaagtcttataatctccaaaatgtccagaatgtaactaaaaatcactcatcataccaagaaccaggaaaaccacaacttgattaagaaaaggaaatcaacagtttataacactgaggtgacacaaatattagaattatatgacaaggattttacagcagctgtcatagaaatgcttaaacaagcgattactaacatactggaaaaagtatagaaagcttcagcaaagaaatagaagatataaagaagaactgaatggaaattttagaactgaaaaatacaatatccaaaataaaaagctaactcactgggtgccatagcagaatggaggtaggaagcagagaacttgaaaatcaaatagaaaataccaaatctgaatgataaagagaaaataataaattggatttcatcaaaattaaaaagaccctgttgagggagatgaaaagataaactgcaaattgggaaaaaatatttgcaaaccgcaaatcaaacacagaatgcatacctataatatataaagaacgcttaaaacttaacagtaaaaaattaacccaattagaaaacggacaaaagacatgaacagatatttcatcaaagaggatatatggatgtcaaatacacacattaaaaagatgttcagccattatgcaaagtggttttgcagtttcttaaaaaacaaaacattcacttattgtatgagctagcatttgcactcctgggcaattatcccaaagaaatgaaaacttaggtccacacaaaaacttatacacaaatgttcatagtagtattattagaatagctaaaaattaaaaacaatatgcatgtccttcaacaggtgaatacagtggtatattcataatatgaaacattatttatactgaaaagaatgaactattgatacatacaacaaaactgatggatctcaagggcattatggcacatgaaaaaagccaatttcaaagggttatatactgcaagattccagttagaaaacattctcaaaatgacaaaattgaacacagattagtggttgctaggggttaaggatgtgaggaaggtagggaagggaggaatgtgactataaactagtagcacaaaggacgtatttgtggtgatggagtagctctgtattttggttttggtggtgcttaaatatacatgtcacaaaattgcatagaaccacacacacagatagtcaaatcagtgcatgtaaaactggtggaatctgaatgtggtccgcgaattgtaccaatggcagtttcctggttttgatactgtgctacagttatgtaagatgtcaccactggaagaaactgggtgaagggtacatagaagctctctgcactattttcccaaatctacaattatttcaaaataaaaagttaaaatgaaaagagttgaaaaggagggattatatatagtacctgagctgatgcagctcatgctgccaggagaggttttcctgcctgagctcttcttgcataatctgaaatgcttttgtcttatcttgatactcctgaagttgagccttcagtggatgtaactcagtgatctcttgattaatctgtaagtattgctgctgcagattcttcaattccttcagctttaaccaaagggaaagtaaaatgattatttgtcacatctcattcatctaactgtaagtcattggtagctccctactaagtagtcagacaccacaacatgaaaccagcacctaacagtccactgatgacatatcactgcaacataagtctctaaagtagtgaaatacatgcagctaggctggtggaaatcacccatggagctgccatcaaggctacagggtgtgactattcctgcaacttctactccttcccctggctcctaaggtcctaagttcactttagggctacaattctgacgtggggtagacttaagagacctagagcttcactgtgggtggtcacatcctaaaacaagaactagtcatgtgtccttgttagggttcttaactttcctacagggctatcaatcttaactgtagcttagcggatactgattataaagaaggcagtgctgctcagtggttaaggacacttaggctctggagttagatatcctactacttcttggacgtgtgacccaatgcatgttcctcatactcttcttttttttttgagagggagtcttgctctgttgcccaggctaattttcctcatctattaaatgaagataattatagtacctttttcataagaatatgagaagtaaatgagcaaattaatgcacttcacacataaagttagtgatgatgacagacttgcctttaattaacaacactgcctacctacatttcagatatattttcaacttctttatctccaatactcattaaaagcttagtaagggagaaataatatcaggacatctgggcaaagatgggggtcttgttcacatacctctttcacccacttagagacatcgctaaagctaaaataatagcattttttaaagcacaaaacacaagaacaggaaaaacaatagaggaatcagcagcaataaaattaattttggaagctgaaaagcagatgagtaagtggtaactgacttaacagatctgagaaagcagaatctaaagctggtagtaagaaaatccaagaatcagtggaacttactctgcagaatcttcaaaaggctcaggaattaacagcatcaggcacctctggaaaagatggtgatgggggtgggagggaggtgatagctgagataaggaggtctagatgaaagctgcttaagaagcaatttcttttaatttttttttttttttttttttttttttttggagagacggagtctcagtatgttgcccaggctggtctcaaactcctggactcaagtgatccctccaccttggcctcccgaagtgctgggattacaggcgtgagccactgcgcccggccagaaaacaacttcatttataggtaccctcttcagctccacactttttgttaccccaacagacaactaattttattctctggacaggtaaaagaagtctctgtggactatggcacctgaggcacagttacaagtaagggtattgttccaaataaagtgaatgcatgcttcctgagtgcttgaagtctttcccctactgagcttgaagagtgctggtaaaaggccttttccctccacaaaggaaatgaaaagtcttctcttgaaaatctgaccagcccaagaaaaactaaagatactgagataagggctaccaataagctcaataagatcatcatgcaatgaaactccgttggtaagtcctacccacaaggttttagaccctccccttaaacatgaagagtacattgaggattaaccttcacctgaagaatggctaacattaaggaagggaagaaaaccaactagagaaggtaatttagaagagattatcaggggagaaaatgtaatgtactcaaagatttaagagataacattgtaaataagaaacattacagcataaattaaaaattataaagaaaaactcattataagaaaacgtcaaaaaacaaaactaccaccattagccttagaaagagaagaaaatctaccggccggggacggtggctcatgcctgtaatcccagcactttggggggccgaggtgggcagatcacgaggtcaagagatcgagaccatcctggccaacatggtgaaaccctgtctctgttaaaaatataaaaattagctgggcgtggtggcgggagcctatagtcccagctactcattaggctgaggcaggagaatcgcttgaattcaggaggcggaggttgcagtaagccaagatcatgccattgcactccagcctggatgacagagcgagacgccgtctcaaaaaaaaaaaaaaaaaaaaaaaaacaagaaaatctgtctatgagacacagaaaaaaaatccttagaaattaagaatataatggcaaaaatgaaaaaaatgttggaatcaaaagacgaaggcaagaaaatcttccagaaatacagcaaaaaaaaaaaaaaagggaaaagttaagaaaattagagaagcaatcaagaaggtcctacatctaaataacaaacatttcagaaataagacaacagagaaaaaggatagaggaaaatggtaaaaaataatttaatgaaatttccaaaaagctgctagtatgatttcttagattcaaaggactagttagcatgatgaagaaaaaaagacctataccaaattatactatcaaaaaatttcagaataggggagaaagggagggaaggtggggtgaggggaagggaagtgagaaacagatcacatacaaaggatcaggaatcagaatagctttagacttgtgaaccacatataagctaaaaagcaataaaccaatgtcttcacaattttgaagggaaattattttcagcctagaattctatatccagcaaaactatcaatcagataagagagataaaaagacattttcaataaatttaccttccacataccatttcttagggatctactgaatgatttattccaggaaaaagatggcacaaaaccaagaaaaggaatacatagaatagacaaaataggagatctaatataggagaaaggtaaagggaaatattctgggatagaaagggtatcctaggagtacagggccactggttgatataggagcaaatcaggtactccaggagaattttcttcctgaagatgaaattgatgggaataaacatcttgaaaggagatgtggacaaatggcagtaaatctgaggttaaattacattaagtacaaagaaaactaaggaacaacaataacaaaaacttattaatctgggaaaaacagaaagactcaggaaaataaaagtaacatgtctctaacgctctagtagcatttgtagtcataaaaaatgtaactctgaattgatttaaccaaaattaaaattaaattacatcaagaaaatgaggaaggggtttgtattaaaatgtgcacacactggccgggtgcagtggctcacgcctgtaatcccaacactttgggaggctgaggcaggtggatcacgaggtcaaaagattgagaccaccctggccaacatggtgaaaccctgtctctactaaaaatacaaaaattagccgggcaaggtggcgtgcacctgtagtcccagctactcgggaggctgaggcagaagaatcgcttgaacccgggaggtggagggtgcagtgagctgagatggcgccactgcactccagcctggcaacagagcgagactctgtttctaaataaataaataaataaataaataaataaataaataaataaaaagtgcatacactaacagggtttactgtgaaagcagggagagtacagagagctaaaccctgttagtgtaaagaaaatcaatagttgatgcaacaaagagccaaaaatgcaatataagcatgatatttacatacacaggaaatactgaaagaataagctaaaagggttgaaagcaaattgcctcagaagaaatggggttgaggtagtgctactcttagcttttcccaccaaacattgtagaatttagtgactaattaaatatgggtcatataactttatttttaacccaaaccccaaaacatatttttgttttgatttaaggtaaaaacatattcctttatgcaatccactcactcctctagtctagatactagactagaggtatcctagaatggaccatcagaaagctgtgtgcctgggactgcattttagctccttggagtggtagttttagtgaactggacgtaattcttttgctctgcacttacattaagggacagctaaataaaaaccctaaaaaacacattattatatttactgtagagaagtaatggatgtttcacaactgcacagtgttctctttatgggaacacagaagaaatttcttacaggcctcaatacttaaagactattcttgtcttgagtaggtgatttttctttctccttttctcctagactataaatactgcagttcatgcatgcggttttcattccctctttctgatggctaatagaaacctcagagcaaactatggatccctctttctaacacagtacaggatatggtgacttccccttgggacactaaccttactcctggtttgatctttttctagcctatcctctttttctcctccttctcagtcccttttattttatcttgaaaaattgtttatatctttatatgctaccccaagtcattttcagaatgaggagagtatagataaatacaggcacccctagagatatgtcatctgcttagtcagttctatgctaaagatgtacaaataagtataagacatgacacttaccaggagtttgcaatctaattggggaaataaaaaatagtgtacagaaattaaacatatacacacacacacacacacaataaggcaatatgggacaaatgataagtaaaatactagggaagtacaaaggcaaaagacaatcaggcaatcacgaaatgtaagaagaggatctgagctctggaatgacctttaaatagtgggaaatagacactcaaaaaaggaaagcaattgggagaacattttggctgctgaagataatatgggtaagtaggaagtaccaggtgtgattattgcatactgagtagatcagtttggtgtgaatgaagggtatgagtagggagcagtaaaagggaacgctggaaaggtatggataaattacagggtcttggccaggtgtggtggctcacgcctgtaattccagcactttgggagccgaggcaggtggatcacttgagaccaggagtttaagaccagcctggccaatatggtgaaaccccatctctactaaaaatacaaaaattagctaggcatggtgtagtcccagctacttgggaggctgaggcaggagaattgcttgaacctgggaggcggaggttgcagtgagccaagattgcaccactgcactccagcctgggtgagagagcaagactccatctcaaaaaacaaacaaacaaaaaaacagggtcttaaatgccagactaaagggggtttgaatactaagtctattctagagatagtacaacttttaaatatttttgagtagtgcagtaatacagtagagtttcagaaagacttatatggtgatggtctgaaaatactggtgagatgataacctggaagcaacattattagaacagtttaagggtaaagtgttagagcttatcttaggatgttgaagatggaaaataaaaatacttgaggcacactgtgaataaaggagtgatacatcttgatggttaaaataaaatcacagttatgagcatttgggaacagaataatatgactctgaattacagaaacacgaaaataaaaaagttggcttggctgtaactatccagcagacaaaaatgtgcaaagtttagtgcctagtgtttataacagataagaataataaagcaattcactgaattaaacatagttagctaattcagaatctatcctaacagctccatgaaaaaagattttgacttagaagataatcaataccagcatatcataaattacagctttgaggcacataccatcctgatgaatagaaccttttgcatttacggtctgaaaagacagacaaaaggccaagctcccagggcaaagtcagctaaactcaaattatttaaaaaatataaacaagtatgtgtatgttggaagtaaaaaccataactgaacagagaggctttgttcggattacaaaaggggaaagactgtctataaatatgggatattaagtgagataggaatgaatacaattacctacaataaaaaggaaaaactcactctacagttaggggtaataatcttttcactagagctcatcttaaaaattagaattttcgctctccctctccctctccctctctctctccccatggtctccctctccctctctttccacggtctccctctgatgccgagccaaagctggactgtactgctgccatctcggctcactgcaacctccctccctgattcttctgcctcagcctgccgagtgcctgcgattgcaggcgcgcgccgccacgcctgactggttttcgtattttttggatggagacggggtttcgctgtgttggccgggctggtctccagctcctaaccgcgagtgatccgccaacctcggcctcccgaggtgccgggattgcagacggagtctggttcactcagtgctcaatggtgcccaggctggagtgcagtggtgtgatctcggcttgctacaacctccacctcccagccgcctgccttggcctcccaaagtgccgagagtgcagcctctgccccgccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggctgcccatcgtctgagatgtggagagcgcctctgctccgccgccccgtctgggatgtgaggagcgcctctgcccggccgcgaccccgtctgggaggtgaggagcatctctgcccagccgccccgtctgagaagtgaggagaccctccgcctggcaactgccccatctgagaagtgaggagccccttggcctggcaaccaccccgtctgggaagtgaggagcgtctccgcccggcagccaccccctccgggagggaggtgggggggtcagccccccgcccagccagccgccccgtccgggagggaggtgggggggtcagccccccgcccggccagccgccccgtccgggaggtgaggggcacctctgcccggccgccaccccgtctgggaggtgtacccagcagctcattgagaacgggccatgatgacaatggcggttttgtggaatagaaaggggggaaaggtggggaaaagattgagaaatcggatggttgccatgtctgtgtagaaagaagtagacatgggaaacttttcattttgttctgtactaagaaaaaatcttcggccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaattaaaaaaaaaaaaaaaaaattagaattttcagattctgggtatgggtcacatttcaaaatggaaagcctagcctttcaaaactccatttatttcctatttggcctattttcctacaaatacaaagccttgatagagttaacagactatcatgaaagtgaagacagtaatgttgccaagtagaatcccctaacaagccaagagtggtggctcatgcctgtaatcccagctacttgggcggctgaggcaggaggactgcttgagcctaggagcagtagaatcctgacaacctggcttggctcatacagttccagttttgcccctgaatcttgggagacctggattaaactcctgactcctactaaaagctgtcaaatgtcagcattaggaagcctctttagctttttctcccattggaaatgttgggtattaaaaggaagtgggtaaatggttcagcctgcaaataaaactttactaaaaagtcatttcaacttatttaaaggaactctttttacgtcacttttttttatttttgacaaattagggttgagttacccatgagatgaactgagtcctttctgctccaaattctaccagataatctattgctaaattgtaaacaagacactaaatgatccttatacttcactgtaagaaggcactaagtgatccttttactttctttcagttaagctatgacaaattctggaaacatttacacatgtctttgtgtatataaaatatataaaacagttctccacctcttagtccttttataaccaatggagagttttgtgccaaggaaatttctgattttttttctaatggtattggcaggtttagcaatttaaatcatgtttctgtgcttctctaagaccaaacagaacctgtgggatacataatactttccctgcgttcccagataatatgtataagaatgtgtttatccttttctataaaaataaatttaaagaaaggttcaaaaactcttaaacagatcagaaagaaagaactagctactcactagtctgtctctgtcattttggagtgaagacatagctttttttaaactctgtacttcagctgggctggtggaaggctgagctgcagacctctgcttcccttcctctgactttcgaaatttctccagctcattccacaggtgatctctctcattctgcagactggccatagccttggaaaaggactgcacttggttataagaatcttctagttgtgaggacaagtgaagcaattgctcatctttggataggagctgttggttaagtttctcaaggtgagacaagctattctcctcagtggagttcattgaaaaggcggtttcagaaagaagagcatctctctctctgtttaagagtccctgttctttcaactgtgccaattccttcagactggcatcatatttccttttcagttcatcaagttcctcattggcatgatctctactattttgcaaggaactcatagaccttccaaaagactgaatttgtgctgtgagacctttattttctttggtgaccatgagtaatttctgttccatctccaccaaatctcttgctagctctgccactctctcttctgctgtttcagtttcatttctcattatccctgcatcatgatgaagatgctttaattctttcttcagtttatcttcaatttcacctaccttcttggcagcttccttttgaacacaaaccaattcttcttccagttctgcaattctcttttgagaggaggaaaacaaagcacttaacctgtgtacctcttcttcttttacttttaactgggcatgatagagtcctaaagtaccttcttcttgcaaggctgttacttgtcttgttagctgggatatagatactttcaaactctcaatctctttagataaatcttgtttctcttcttgtagggcattaaaggacctccgcagatcctcatttgcttcctcagattccttcagcttttcttctaatttagcatatttattttccagctccttattttgctgaagttgaacttcaagaagctgcttttgttggctgtcctttattgttatcacttggttcaggtcttctctatattggatcagttctgcatctagcttggcattctcagaattgagatcatccatatgacttctcaagcctcgtatttcttctttaagcttattattctctgcagcagcctcttggatgagttggtctttttccaagattatagagagatgtcgctcttccagctgttgatagtcacccactatgcggtctcgatcattttggagagaagacatggatttaacaaaggaatccaactgtgccttttgctgaatgttttcctttttgatggttttcagtgtttccataagctgattggttttatcaacagcctttttgttctcctcttctaaaacaatattctcctcttcctcctgggacagcaggttttccagctctttaatttctttatcatgttgctgacgcagttcagcaatagctacttggattgcctcttccttgccagaaagcaggcttataatcttttgctctttcatatttatttcttcatgcagcctactggtcagttctctggaggcctgaagatcagtctccagttgttcataactgaacttagaattttgaatatcagcctcttgctgccttatgatcccttccaagtttcctttttgttccttacatttttctaaagagttacttaaatcagtcaactggtctttgagactcttaagttctgattccaacttagctaattcattctgagaactgtggtataggtggcgtgtctcttctagctgggacaaaagttctttgttttccccctgtagagtatcacagaccttctgctgaagctggacctctgtctgggccttggactcccaaatctgcttgtcatgttcaagcctgaaacagagagaaggtcattagttacagatttcaagaaaaaaactgtgtttcccaaggaacaaatactataacatgtactcaatagatttacaaatgaattaacattcataacaggtgttaaatattttactgaagaggtattaattctctgcacctacatgtttatctactgagtgctatgtattaaaggtatatcatacttaagggttcatatatttaagtcataaactccaaaatatgtcacttattttagtgacatggttttcaacactgaaaagtaacattttctcctattttattctactttgctccagacaagctaacgtttggcttctctaagggataatcttgatatgaaagacagtgagaaaatctgttttagaacagaagggtcctattggaagtaaggaatacaaaggatgagagacattattagttctatagattaaaaagtgacagaaaattgaaatttgagaaaaaataactctaagaggtatatgcagtatgaattaatgtggactaaaggaagaagaaaagacgagactagacaattaatttgagagtactgtggtaaaaatccaggcaagagtagttgaaatggaaatgaaaagaaatacagaggccaggtgcaatggctcatgcctgtaatcccagcactttgggaggccgaggtgggtggatcacctgaggtcaggagttcgagaccagcctggccaacatggtgaaaccccctctctactaaaaatacaaaaaattagctgggcgtgttggtaggctcctgtaatcccagctactcgggaggctgaggcaggagaattgcttgaacccaggaggcagaggttgcagtgagccaaaatcgtgccattgcattccagcctgggtgacaagagcaagactccatcttaaacaaaacaaaacagaagtacagaaatctctcaatagaaagatgggaagagaagatgcgaacttttcatgttcatgcagttgtagcaggattgttgtttgccaaaaaaaagtcagaagtgagagagaatatatcttccatggacatttatgccaaaattagtcccattgtctaaaaggaaacagaaatagtttagagactttctttgcttgaagttacctctggaggaggaaaaattcactactcatttacctggaaatgttaatctttaattcttccatatggatggacatctgtctaagttgatcctttagaacactgcaattatcttctttgagtctaatttcttcttctttgctttgaatcgcatcactaaacttcctctcccatttcttagcttcatctatcaccctgtcacgatcatcctggagggaagacatgctcttagtaaaggctgcaagctgggtcacagtactgtccaagttttcctgaagttgctgaacttccttgtctttcttgttcaaagtaacctgaatctctccaattgtctcttccaagtggactttttctctgcgcaaagcatccagtttctcttgcatattcttcttctctttcaggtgcttctcttctgcctgttccagtcttcgctcaagatcttcatccttttgtttcatctggcttttaactgattctttatttgactgaagttcctttttcaacttgagattgtctgctaggacccttgctgcttcactttgagtgtcatctagcaggactttgaagctagctaattctgcttgtgcctttttgcggtgttcaactgcttgagccagattttctttggttatttccaaatctttttgagattcagtttgaacaaattctagagctttaacagttctctccagagcactaattttctcttgatacctgatgcagtccttctgtagctgctttacttcttgttgtttttcttttaacagttcctgaagttcctttgcatggcttttatttccgggttctttctgagcaccttgtattttctccaaatattcctttcgtatttctgattccaccttagttttttccttgactaactgctgcttttcttcttccaattcactcacacactttttaaggttcttcatttcagattccaatagctcattttttatttgggcatctgtaacatcctgacagtaattcccaatgcttccattaagttctgctaattgattcataagcctctcttccaaatcatctttctcttcttctgctgtctcctttagtttggtaactctggagagttcttcttggatttgctgatttaacaggttcattttggttacttcctcctgaagcatttttagttcaccatcctttgttgatatctgactcagtaaggtatttttctcattttctaaagtctggctaaattccttgtttttctgcttctcctcctctaatccagcaattctttctttgagctgatcaatctgctgtaggtagttattaatttcatcatgtgagctgaaatccttacttacagcagggttggcactcttcgctgatggaaccgattctgaacatgtaggtcttgtgctcatactcagagagtcttgctcttcagtctcacctggtatagactgtgttccctcttcagtgacattcgtttggttatcatgtttctcggtggcctctaggttagcttgtttagatacattaccttctatctgatgctttaaatcttgaacctcttcacttagagagtctttctcagacattaaagactgaaacttcttagaaagggtttcatactccattttgaccctttcaagttcttccttcatgctggcattggaagaaagaagtgtttccatacactctttagctgtatctcctgcagggtgcacctctgccctaagccggtcattctcttcttccagctctaggattttctgctgtttagatttagcaaactttctcatcttttctttcatttcctccatttcttgctcagcttcctgcaactgcttttctgtctccttcttgtttgcctctgtgcttcttaacttgccatacagttcttgtttctcttgcctcacagcttccaccacatgctgaatcctttctgcttcattactaacattctcataggactgcagaagaatttcatactctttttgtagctccttgtgtttctcttgccactcagtactttctgcaatcttagaagatttcaaagattcaatttccttcactaacttttccttgtcttcagtaagaccctctagagctagttttagactttcacaggagctgctgagactctgattttccaataaagacctgtccatttctgtaatgagtttgtctctttcttcttgaagaagagctaaccttcctaagaccgtatctttttctttattttgagcagaaacttggctttccacatctgccagagacttggtgagacgttcaatggtacctctggccaaagacaattcctcttggagacttttgttttcttttagtgcttcttttcgggaaataagggcagcttgcagtttcctttgtatttgttgctttgctctactttcttctccaatctcttctggtttttgcttcatttcacaaagttccacctgtagctgctttatcctctcatcatgctctttggcttgcatttctagctgtgtatgcagagccttaattaaatcttcttgttctattatctctgtctgtattttagtgagagctgcttctttctcactaagttgtccagaaaggtagctaacgtcttcttcctttttgcttatgagtttttgcagttcatccagtttaggttgcaattctcttagatgttctaggccagcaatttgtagttggctgctttccaatttctgctgcaggctttcggcatggacttcagcttcatgggatactgtctttagactctcgatttctaaaccctgtttatttatctgctcttgtaactgaaatacctcttctgattttttagtaagctcacttgttgtagaactaactttcaattctaactctactttctcagcctctatttccttcagctgggccttaatctgggcaacagaagttccgccctgcagagcactcgcatcttcagaatgagaaggccagtctgggcacaagttggactctaaaacaggttgagtgtgatgctgttctgtggctttgaataaaggttcttctaaacctggagtggaagaacacgattcctgctggtctgtgcttgggagttttccgtctatggattcccttacttgaatctggagttgccttagctggtctccaatattctcattttccttgctttgctcatcaaactgttcttgcaagcgattatagtcatctttctgttgctttagctcctccctgagatgtctttctttctcctgtgcctttttaagaattgccttgcgggaggttaaggcttcctgtagcttcttttgaagttgctccttttctttttcaagggccagtatcttttcttctagttctggtttccagtgttcactactacctgtacaaggtggacttatcaccactgtttcctttacaagtgctacggagtccccatcacttgcatccgtgttacttgtgattaacttctggataattgcttggttttcactgatttctgcttggagcaaatctatttggtttgttttatcttgcaaggtctgattcatctgtttgaccagagcctggaattgctcttcagctgccagcttttcttccaaatccttccttatatgctgtagttccacttctttctcagatattgtctgttttaaataaatttctatttcttggcacttagaagtcacacatttttctgagtattctttgttttctttatcttcttccacttctcccctctcagtctcactgagtgggatttctttcttagattcatctttcaagttggctaattcttcttccaatctactgactctttgcagaagctcctttctgttaataagagctgcctggagctttctctttctctgctcattttctttcttcagaaggtcaaattcatgctgaagttcttccttacttatttgtcctgctgggctcatctcatcataattttgtttaaggccagaagaaacttcattatcttcttccacctgctctttttttgcttcctcagctctggataataaatttagctgttctttaagagtcttaatttcaaccccaagagaaaacttctcttcattaagctgaaccattttctcagtcatactaaagctgatttctgtcacttgttgatccttctcctcgatggtttgttggagggtttccacatctctctttttctctagtaagagctgatccatttttgttatttcaagttccttctgtgaaagagcctgggacagttcttccactttacttgagatatgccttacacgttctgccccctcaagcacttcactttccttattttgcagctggctttgcaggcttcttatcagggtactctgctcagaaaactgaagctgcacatcatccagttcattctgtaaaacttcaattttcacatctttagatttggcttctatgctgagactatggatctgttcagtgagcaggttgtcatgggcagtttggctttcataatcaagtcttctttgcctttctgcttctgcaaggttcatttccagttgctttacctgagccctcaattctgttaccatgctaagttccttcacctgagagagaagctggtctctttcttcagacaaagcagtgaatgcactgctgttgttgtcagcatttttcttaaactcctcaatcaactggtttaggttgctaatttccttagctttctcatctaaatttttctcatagatttcttgtgctttatgaaagtttagctcgagctccaaaatttgactttttaacctttccaactcatcctgatgacactgaccaatatctggtacagcagaaagggatttatcaccatcctgctttgttgatttcaattctactccagcatcatttaaagatatttcctcagatgttctactttgatgttcagtgctcgcctgttctttttcaactgctggaagactgctctcttcatttggcattaagggaaaatcttgccctgtatcttcaagaaatactttcattttaattggagctattccctcaccctccatctgtttcatttctttctggtcaaggacctcatgatctgcttcctcagccctttttccctggagctgtaatttaagaaatgcaatttcctcttgagcttctttcatttccaacaataaaactgataattctttatgtttctgagaaaatgtgttttctagaacatcttgtccactttcctcagcagaagagctcctcttgttggcaatatcaacaatgctgatctatttttaaaaaagaaaaaaaaagctgtaatcaaatgttttataacattaaaaaaatagcccaactaaaaacttgtatttcatcttctaaaacttcagactttttggtcaaaaccttctttgtaccataacactgctaaatccttttaaaatcagtttgtatctcccagctggacctccaagggcactctgccaatcctgcactgaagtcaagccctattcataagacctaaggaaattgggaattcattttctagatattccttacataagaagctttttttccttcagaataaaactcctaattgattttttttaaaaagtaagcagatacttttgttaggaagccacattactcctcaagggcatgtataattctatcactgacttactgattagaaaaacacagctaactaaacaaaacgcagctaacaatactcttaaatcaacagaatgatactaagcaaccatacccttcttatagtaattttcagattattaaaaggatcattctccaaagatccctttttatttaatcttagtaaaactatgccagtcttatctaatctcttcactgagaaacttttctgagatgaacaaagaagttgagatagatgataacccagtataaaaaaatgtgttatcaaatcccaaattagtagctactgtatttgtgttgctttagaacaatgaattttaatattcagaaacaagtaacaataaatgagatataataaccattatgaatctctttaatagatcttactctataggtaatgtacttctctggcaacactagaaaattatggacgtattttcatatgaagctaccttctcttaatctagctcatgttctggttatattaagaacacatcacttacctcactgacttctctgtctgcctccccagttctattctgagcctctaggagagtaatctgagaagacagtttttctgaaagtcacaaaataaatatctttagaagatatatgtggagtgtgtgaaaaaacaggattgcatgtgaagctatttgaattgtatgaaataattttttaaaaaataaacaaaatagcttgggagaggtgaaagccttattaaagaagtggcaagaggatatgattacatgagatataagatagaacagtactaggtgatgataatgaacctgaatgaagtatactaaatagtggaaggtttgaaaggagaaggatgccaggatgcaggacataaagcagctatttctgtggcataatctggaacttctaggacaatacatataatttatccataatcctactatgtttgtaatatatattttgcattaatatagcacttacaatgttcttcaatgttcataaagatatcaaattttagcactaaaagggagctatcctatctcctcaatgatcatataaggaaacaaagaaatgacacaacccgaaaggttacgcagctagttcagggagctgggattagaatccaagtcttcagagttttaacccaagttctgtgacaatgtgtatatattgagcatcaatatcaatatcctcaagaagcttatattctttctgagaagataacacagatacaccaaaggaaaaaaatatatatattttttacactgtatccaaatgtcttaatgtgacctacaggaaccctcatgctttgaccctactaattctccaacctcctcttcttgtattgccccctttttgttcactctgctctaaaaacactggtctgttttctcttctgcaaacttatcaagttcattcacacctgagaacatttgtactgcttttttctctgcctggaatgctctctgcttagcctctttgcatggctgtccccttttcatcattcaggtttaaagtcctcagaaaggcctactctcactactccaattctgcgttcctcttctccaaggcatacttgaaatactctgttttattttaagcctaatacttatcattctctgaaattttcttatgtgtataaacaggtttgtagtctgtcttcccctccaatatgttcatagctatatacccagcaactggaatagtgcctggcacataggaaagccaccatagatgagacaagggaattcaagacagtatatatgttcagacatttcacaagattacttgaaaaaggagtacagtggtagaaatgtcagtgcaaaaggtgagttgaaaacaacatgacatacaaggtaaaagtaatctatgaggccagacacaaaaaccaatacagaaaaccttaaggtcagtgatccctgcaggaaagagcaaaggaatggaacccatataatacctccaaaccatgtgaagccacatggataggatacagactgtttgcaaaactgcaaaataagcatcatggataaggtctcaaagaagtgctctgaatgggttaaataatgagctgaatttgtggtgttctttacttattagaaatagtgggaatcgtctaatacaagtgcataagcttccatttagatctaagtggaaaactgtaaaatggttaagttagaaatactggctctagagtttaataaaagttttacaacctttacttgctattcattctcactcctagatgataaagtgtagtagtcagttaaagatgaattagatcaataaagcattaacgacacgctactaaatccataaagtctacatgaagcatatgataagtggaaggagacacgtcttcattctcactaactgttcacacacaatccaataggataaaatgctaagttcagttcaatccaacaaaactttattcagtagccattatttgccaggtggtatactagttttgggtaaagcaaagatggaaaaaaaaatggcccctgcccttgaagagcttatatttaaactttgaagagcttataatatagtaaaaaagacaaacatataaacagatcattttaatacaatgttaaaagtatacaaggatgttatggaagcacaaaaaaatcatttaacccaacttttggggaccaataccaaattcctgaaaaagataatatgctagtcgaggcctgaaagatgagtaacaatcatccagactaaaggaaaggagcaggattctaagcagggtacagcacgagcataaaccactcactcacaacatagtttctacctttaaacctttatactgatctctgttacctcatcccacaaatttattaccagaatgtcctttctttcttcattttacctattttaaaaatcatcttattaaggtcctgttcaagccatacttcctataggatacgatgaccattccaaaatgattatgagttataaagaaatcctgcagcatgtatagtccatattgcaaaatgttatacttatgtaaacactgatactatgctctaattgtttaatgtgtattatctttgatagttaccagctctattatctaaatctttattatcacggaatcagagaattctacatgttatacataattagtgataaaagtagaggcacttgtgggataagaagacagagaattatggttttcttttatacataccattctcagctttcagctcctccagctctatagaactaaggagcaaggctcccttttcattctctagttctaccactctcttctgcaaagaagcaatattctcctcagtgactgcctaaattgtagaaagacaacaaattaatgattctccagcagaaaattctcacactaacgcccagatagcctccagcatttttgtcttctagaagttctccagccatgaaaatactttaaaaataacatctacttatctgcctaggtaatctttgaagaaaagtgttttatctaaagatttagaaaaagaaataaaatatttcacacaaatatcaagttcattggcttttaaatttaagattgaagcctggattacaaagatagaaatcccaagtctatagcataagaaagaacattttcaggttcacaaacaaatagtattacaagattagattaatgtcaccaagtaacatggtctctctcctgaaggagaatgaacatgaagagaggttccacaaagaggaatagaggcaaaggaatatgtacctcttaagaaaggaagaagatttataaaattgttttttgttttccaagtataataaaaattcccttggcttaatttatacatccagaatttttggttttcctaaggataggcatatatctaattatgtcacatctttagttttatgtctttgtatatattttttattctccatggatattattctataaaattttcatacaattgtagaatttttaagccatgagggtctttacagcatatttgaccccgaaatcttcattcaatgtttaaaataaatagcatgggatgaatttagggtttttatggcttttatcttgagggaagttcccagtttgcagtatgcagggcaagtaaaattccaatagaatagccacagatatttctggcttgaagaatgagaagagtttgggacaaacatagctgccaggatgtgaggagggagatcagagagaagaaaaagagttaggaaggaggagccctgaattctgtgtataaacttagctgaaatttctgactgaacaatggcacaatgtatttgttggactgacttaaagcagcccagctaaggcaaaaataactgaactgagttttgatgcctctctatcataggccagagtttggggtttgagtccaacttactgtctgataaaaagtaattgaaattttagaaataacaaaataaaatcttgagaacaaaacacgacatccagaattcaaaacaaaaccattcacacataaagaaataggaaagagtgacccattctcaaggaaaaaaaatataatcaacagattctagccataaaatgatgcagattttgtaagtagcaaacaagaattttaataaagaagctattatatctatgcttaggacataaatgaatatgctcataatgaatgagaagaaaggaaatcttagtaaaacaaacaaaaaaaaataatgaaccagtttgaaattccagaactaataaacataatatctgaaatgaaaatttcaatgtgataggcttgacagtagaatatagacgacagaagaaagtcttggtgaattgaggatgataaatcaactgaaattatccaatctgaagacagaagaataaaaaaaattgaaaaaaaaaatgaatacaacctcagggacatgtgggacaatattaaaaggttcaatatacgtgtaattggagtaccagaagagacgagggacagaatgggaagaaaaaatattttaagaaatggccaaaaatttctcaaacataacgttatatacgtaagaaactcaacaaaagcaagcaagaaaatgacaaagaaaactataactaagtacttcatagacaaggataaaaggaaagtcttaaaatttccatggaaaaatgatactttacatacagagaaacaataattcgaatgactactgaccaattgttagggaaaaaatataggccagaagagggaaacaccttctttaaagtactgaaagaaaggctggacacagtggctcacgcctataatcccagcagtttgggagggcgaggcaggtggatcatctgaggttgggagttcaagaccagcttgaccaacatggagaaactccgtctctactaaaatacaaaattagccaggcgtggtgactcacgcctgtaatcccagctactcaggaggctgaggcaggagaattgcttgaacccaggaggcacaggttgcggtgagccaagactgtgctattgcactccagcctgggtgacaagagtgaaactccatctcaaaaaaaaaaaaaaaaaaagttctgaaagaaaaattgtcaatcgagaattataatatccagtagcaaatatcattcaagaataaaagtaaaataaagacatttttagataagaaaaaaactaagaaaattttttcacagacagacctatactataatattataggttgttgtagaggctgaagaaaacagtatcaaatagatatctgatcatcagagaggaaagggcattacaaatggtaaatatgtggataaatgttaaggtcaatattttcctcttaatgtctttcaaatatatataaccattttaagcacaaatattaaaattgtgtgctgaggcttattacttttgttaatataatacatacaacaactgtggcatcaggaatagggtgagggtatatgattatgaagattctaccttttaagtgaagtagtacagtattaactcaagaagactgaaaaattatggatatatgttatacttcctagaataaccacttaaaaaatttttgtaaaaagatacagctcaatacccaatagatgacttttgcttctgctaaagactgagtaacatggaacagatttaacctcctacctgaaacaataacaaccaaaaccagacaaaataataaataatcattttcagaatactggatatcaagcaacaaaggataattatctctgagagaggcagaaaacaaagtgatccctaaaactgaccaagcttcatgccttaagagagttttcaggctgtggtccaagaagggggaacataggctgagcctggtagactccctaagttcatgagacagagctgacagtcaagaaagagcaagatggctgcagttcgcagaatagaataccagatgggaaaaagtcacgtaaagagaaaaccctgcagatctgcaaagggactgaacaagtgttcagtgaagtacagggcaggacatgaatgtgaggaaagcatccaaggctatctgaactacccctacctatctgaagagattaaagaatagcacttggtgctcacacaaaacccggaagtgtcagttatatagccaaatgtgaaaaaacacttctcagggcattgagtagaatactcagcaaggtcttgcctcaggagtatcgaatgactgagcactgattcgaaccctcctaacaaatcaaagcagcaggatctgaaaggaccaagtttttttcaaagaatttaactgagtcgcataaaaaaagctccaaaatatgttaacaaaacaaatatagaaacaaaggagaatcacttgaaccccggaggcagaggttgcagtgagctgagactgcatcaatgcactcctgcctgggcaacagagcaagactccatttcaaaaaaaaaaaaaaattaaaagcccattaatgagttttggaacaacttcaagtaatctaatataaatgtaattggaattcccaaagaagagtagggagtcagaaaaatatatatatttgactaattcacggcagaaaatcttccaaaactataaacacagagattgaaaaagctcaatgaaccccaatcacaagaaacatgctatgtcaaggtacattataattcaagtgctcaaaaacagtggtaaaatcctaaaagcaagcaggaaaaaagagagaagcatgacagcagatttcttattaaaaacaaaatgcaagggccgggtgcagtggctcatgcctgtaatcccagcactttgggagactgagggggtggattgcttgagacaagagttcgagactagcctggccaacatggcaaaaccccatctctactaaaaatataaaattagccaggcgtggtggcggttgcctgtaatccaagctacatgggaggctgaggcaggacaatcacttgaatccgggaagtggaggttacagtgagttgagattgcgccactgcactccagcctggatgacacactgagactctgtctcaaaaaaaaaaaaaaaaaaaaaaaaaaccaacaaagaaaacaaaatgcaagaaagaagacagtagagtaatacacttagagaaatgaaagaaaaaaaaactttcaatgtagaattctagtcagcaaaaaataatctttcaacaacaatggtgagataaagatgtcttcagacaaaaagtgttattagaacccatgactggccaggcacggtgactcacacctgcaatcccagcactttgggaggccgaggcgggtggatcatgaggtcaagagattgagatcatcctggccaacacggtgaaaccccgtctctaccaaaaatacaaaaacaaaacaaacaaaaaaatagccaggtgtggtggtgggtgcctgtagtcccagctactcgggaggctgaggcaggagaatcacttgaacccgggaggcggagattgcagtgagtcaagattgcaccactgccctccagcctggtgacaaagtgagactccatctcaaaaaaaaaaaaaaaaacaaaaataaaaacaaacaaacaaaaaaacccatgaccagcagacttgcacacacatccatgtacacacagacacaaaaattaaaagaagtccttcagagccaggtgcagtagctcacacctgtaatcccagcactctgggaggccaaggcaggaggatcatttgagctcaggaggttaaaaccagccagcctaggtaacttagcaagacctcatctctactaaaagcaaaaaaaaaaaaaattagctgggtagcatggtgcatgcctgtagtcacagctactctggaggcaaatatggaagaatcgcttgagcccaggaggatgaggctgcagtgagccatgatcatgccactgcactgtagcctgggtgacaaaatgagaacctgtctcttactaaaaaaaaaaaagaaaaaaaaaaagtccttcagatagaagaaaaatgataccagatggaaatatgaagccagggtttggcaaactttggaggcctgcataaataaagttttattggaacataaccacaaccatttgtttaccttggctctatgtctgttctcactttacaatggcagagttgagtacctgcaacaaagactgtatgacccacaaagcctaaaatatttactatacataaaaggattggcaatctctgatctacaaacgaagaatgaaaagtaccagaaatggtaactgcaatggtagttaagatttattttcttattttaatctccttaaaacataaacataaatgctttatatgtattagccaaaaactgtccacaacccaaattatccatcaatgagtcaatggttacacaaattgtgctgtttacaacatactcaacaatacaatggaatgaattattactaaacaaacattaggatgaatctcaaataagtatgctgagtaaaataagccaacaaaagtgcatatacaacttatataaactttttaaaaatctataatgacagaaagcagatcagtggttgtctaggtagggaaagatgtgagggaaaagattaaaagaggacatgaaaaaacttctagagatgatgaatatgttcattttcttgatagtagtgatggttttatatgtcatcaaattgttctgggtgctatggcttatacctgtaatcccagcacttcgggagacaaaggcaggaggatcacttgagcccaggagttagtttgaggccagcctgggcaacatagtgagaccttgtctctacaaaaaaaaaaatttgccaggcatggtggcacatgcctgtggtcccagctattcaggaggctgaggtgagaggattgcttgagcccaggaagttaaggctatagtgagctgtgatcatgtgactgcactccagcctgggtgagagaacaagaccctgtttcaaaaaacaaatgaacaaacacacaaaaccctctttaaactgtatactttaaatgtgtacacattactgtatgtcaagtatacctttttatacttaatagagctgtttaaaagaaaaagttgtcaataaatgaaaattaaattcaagaaacttctaattatcgaatagaaggcaggaaaaaagaagaagggaaaacagaggggaaaaaacagaaagcaaaatggtagacctaaatccaatcacatcaataattacattaaaaggactaggcactccaatcacaaagaagagaagaaataaaaaagtataacccaactatatgttgccttcaagacatttactttaaagaaaaacaagttaaaagtaaaaggatagaaaagaatataccattcaagcaataaacataagacagaattattttattaatgccagatacagagaaatgtaaataaagaagtattactacagatagagtaacattttgtaagtgaaaaaaggaacactttatctgaaaaataaatgtgtatgtactaataacagagattccaattaccaagaagcaaaaaatgactacattaaaaggagaaacagacaattccacagtcatagttggagatttcaaccccctcttagcaaatgtttcaataaccagacaaaagtcaaagacaaagataacgtgaacaatactatgatctaagtgctatttgtagaacattacatccaataactacagaatacacactatttacaagtgtacaaggtatgttcaccaagacaccatatgctgtgtcataaaataggtctcaataaatttcaaaggattgaagtcacataaaacatattctctgatcataatgaaattatattagaaatcaataagatatctagaaataaaaccaagtatctggatattctacaacaacgtgtttatttagaacacacttctaaacaatccatggtcaatgaaaaaatcacagagaaacttagaaaaatgttcaaaaactgaaatgattaaaaaaccacaacataacaagctatgcttagagggaactgtgttaactttaaatgttcatatgagaaaagaagacttgaaatctttgatacaaagtttcaccttaagaagctataaaaagaagagcaaagtaaatccaagtaagcagaaagaaatactaaagagtagaaatcaatgaaaatgaaaataatcagcaacagagaaaattaacaagaccaaaagtggttctttgaaaagatgggggaaaaaagctgaataaattctagatagactgatgaagaaaatgaagcacaaattaacaacagcagggatcagcgcttacaggcattaaaaggataaaaagtaaacattgtaaccaacattatgacaaaaatagaacattagaacatcttcaatgaaatagacaaaaccccaggaaaaaaaaaaaaagcccaaacaaaccaaaactggcaccgggtggaaaaaaaaaaaaaaatcttattattagccttatatctgtaaaggaaattcaattcattatcaaaaccttcctaaaactccagactcagatggtttcattggtgaattcttttaaaaaaaagtatttaaaaaattattttcaaaaaccgaaataataccaatcacatacaaactctcataaaatagaaagaaaggaaacactcccagaaaatagaaaagggaacatattatgaggctgccatacccttaataccaaaacctgataaagatatcataaaacaagaaaactgtagactaatatccttcataaataagaacacaaaaatccttcacaaaatattagcaaatcaaattcagtactatagaaaaaggataatacagttaactcttgaatatgggtttgaactacatgagttcacttatatatgcacatttttttcaacaaatgtattggggttgggtgtggtggctcatgcctataattccagcattttgggaggccaagggagggggattgcttgagtccagaagttctgtaccagcctgggcaacatgatgaaattccatttccaccaataaataaacaaacaaacaaacacataaaaatagccgggcatggtggcatgtgcctgtagtcccaactacttaggaggctgaggcgggaggatcacttaagcccaggaggttgaggctgcagtgagctgtcatcacaccactacaccccagcctgggtgatggagtgactctgtctcaaaacaaaaaaataagtaaaattttaaaaaaagaaaaaaaaaaggccaggcgcagtggctcacgcctgtaatgtcagcactttgggaggccaagacgggtagatcaccaatggttaggaggtatggttaggagtttcagaccagcctggccaacatggcaaaaccctgtctctactaaaagtaacaaaaattagccgggggtgttggtggacacctgtagtcccaactacctgggaggctgaggcaggagaatcacttgaacctgggaaatggaggctgcagtgagctgagatcacaccactgcactccagcatgggcaacagtgaaactccatctcaaaaaataaataaatagaaaaatttttaggaggattgctacaactagacatttgttattactcatagaagaatcacatagcctagaaatataaaaaaaaaattaagagaaagtttattttaaaaattaagaaaaaattaagaaatatcaaaaaaactaagagaaaaattcctctacaagattgaggatgatctgatagaggaaattccttaaaaacctaaaactagtatcacagccaatggtaaattatggaacactttcctcttagattagaaacaatgcaagaaagtccagtctcaccacttctattaaacagtgtactggaggcataaaaattagaaagaagtaaaatttgtctttattttcagatgacatgattgcttacatagaaaatcctagagaatctacaaaaagagactaaaaccaataaaattaatttgtttatcaaggtcacagaatataagcttaataaaattcagttgtatacttacatattagcatacattggaaaatgaaataaaaataattccatctataatagtatcaaaaatattaactacttcagaataaatgttataatgtgcataatttctccaatgaaaactacaaaacactgctgaaagaaattaaagatctaaataaatggagagatatactatattcgtagatttaaaagtacagtagtgttgtcaattcttaaactgatcaatagactccacacaataccaattcaaaatctcatctgtctttttttaaaaagtagaatttgagaagctgattgtataatttatgtggaaaggacctggaatagtcaaagcaatcttgaaaagaagaacaaagttggaggacttatactattaatacttgacttcaagactaacaacaaactacaataatgaagaccgtgatactggcatagggactgacagatagatcaatataacagaacagaaaattcagaaatagatgtattagtctttgatttgcaacaaaggtaccaaaagaatccaatgaggaaagtaaagtctccttacgaaatggtgctgaaacaacgaaatatccgtacaggaaaaaacaaaacaacttgaccttcaccttacaacacacacaaaaattcatttgagattcagagacttcaaatgaaaactaaaaccataaagcttgtggaagaaagcataagagaatatcttcataaactggggctaagcaaaggtttcacagacaggacacagaaaaaaaaaacaataaaaaatgataaataattaagctcatcaaaatttaaaagtgtgtgctaatgaaaagatatcataatgaaaatgaataggcaagccacaaagccacagcatgggagaaaatattcaccaaacatatatgataatagattggcattcagaatatataaagaattcctacttgataataaaaagacaactcaaatttaagaatggggaaatgatgtgaacagacacttcaccaacagaaggtgtacatatggctaagaatctcaagaaaaaaagttcaacataatttgtcatcagggaaatgcaaatttaaaccacaatgaaataccactacatacccattagaatggctaaaatgttttaaaactgacaccaccaaatcttggagaagatgtggaacaaatggaactctcatatattttaggtgggagtataaaatagtacaaccacagccaggtgcggtggctcatgcctgtaatcccagcactttgggaggccgaggtgggcggatcacgaggtcaggagtttgagaccagcctggccaacatggtgaaaccctgtctctactaaaaatacaaaaattagccgggtgtggtggcgggtacctgtaatcccagctacttgggaggctgaggcaggagaattgcctgaacccgggaggtcgaggttgcagtgagccgagatcgcaccactgttctccagcatgggcgacagaccaagactccgtcttggaaaaaaaaaatagtacaaccactttgggaaaagacctggcagttccttataaagctaaatacataggtactctatgacccagcaaagcaattcctcaactagtatttactgaagataaatgaaaacatatgtccacataactatttgtatgagaatgttcacagcagtttgattcataatagccaaagcatgaaaaagtccaggtgtccatcaataggaaaatgcagtacaatcatgcaaaaggaaaattcagcatgttcataaaataaaatacttctcagcaatattaaagattaaattataatacatgcacaatatggatgaatctccaaatatgctgagtaaaagctttacacataagaggacctattgtatggttaaatgtatatgatgctgtgaaacaggcaaaattaatctatggtgaaaaatcagtagttgtctttggaggggaagggtgaggatgactgtaaaggggtatagggatactttgtgaggtgatggtaatgtgatatatcttgaataggagtttgggtaacacaggtgtatgcatttgacaaaactcaaggaatggtatacttcagatctgtgcatttaaaggtttgtaaatcttacctcaaaagaaaaagaacaattataaataaatattaaaatatagtcaatgatatgaatgctgacaaatttagagagaaatgtactgatgtccacaacttacagtgaaatgtattataaatttaagatgaactgatggatgggcagagggatgaataaatagatagacatttgataaagcaaacgtgctaaaatgttaatgatagaattcagatggtgggtatacagatgttcgctacaaaactcttgcaacttattcgaatggttggaaaacgtcttaacaaaacattggaggaaaaagtcgagaatgggagaacagaagagactggaaagcctagatgctagaaaccaagaggcaaaaatttttatcagtggacagcatagcccaggaatgacaggactctgctgaccaatatgtttgtgagtttggaagggtataatcttacaatggagatgactgaatctagttatctcaacttgacattagtcaattaagaacatcaaactaactgccttcattctgatattcaggctcaatcagcctgaatcagccttcgatgattacaatctagctctctacagagatttttgtagatgaaagaaagaatatactggccaataagaagctacttggccattatatacttttttactgttaattaattaatgggaacaatatgatttccatagtagacttttaagtttgattagactgactcgtgttcactaaacctgatcaaatcttagtttaccaaaaaaaaaaaagacttccgaactgggaaaattaactacagaagcaaaagtaatgattcatctccgatacaaattgttaagaccttagaatcagaaaggcttctgagaccatggtatttgttatctattattttctcattctttattgttgaaacactgcattaatgcctttcatgattcctttcaaatagaattgtcctcaaaaaagtattttttcaggcagaaaaaacagaaggtttatatagctctctggaataaatcctcattagagcaccgaagtacagatacagcaaagacaaacagttaatattcataagaagttcacatttaattacctgtgtgccctcattataaacatctgggaaagaagtctgagatgctgtttcatgttgttgcaagggcagtctatttagaaattggctaatttctttggatttttgctggagctgatctaaggaaaagaaaaaaaataaatgtaatatttgcttcaagtctgaaatgtagttattattatcttctaaagatacactgtatgctgtttactagtttagtttccttagttaaaattatgatgccaatgacaacattattattagctaaatgttaaatgttctcaagaaccaaaggacacctcagtaaatcacttccttcaaaagtaaaataaaataggcctaggcactttttttttttttttttgatacggagtctccctctgttgcctaagctggagtgcagtggtgcgatctcggctcactgtaacctctgactcatgggttcaaggattctcttgcctcagccttccaagtagccaggattacaggcatgcgtcaccatgcctggctaatttttttttttttttttttgtatctttagtagagatggagtttcaccatgttggccaggctggtctcgaactcctgacctcaggtaatcccccccaccttgacctccccaaagtgctggaatagcaggcgtggggaggcctagccctaggcattttttacaagttcattttccctttcccccttgaaaatggctttagggtttttgttttcttcactctcgacttaggtattatggatcccaccaagattccaccacatggttttaaacatcagcatgcttaagagaacagcttgctcatgtaacaccctggtcttgtgtgatgcccttcaaaactgtctggctagggcacaatggctcacgcctgtaatcccagcactttgggatgccgaggcgggcagatcacctgaggtcaggagttcgagaccagcctgaccaacacggagaagccctgtctctactaaaaatacaaaattagccaggtgtggtggtgcatgcctgtaatccaagctacttgggaggctgaggcaggagaatcacttgaacccaggaggcagaggttgcagtgagccgagatcatgccattgcactccatcctgggcaacaagagtgaaactctgtcacaaaaaaaaaaaaacaaaaaacaaaactgtctggctaacattcagttattcaatacaaattttcaacttaattgtttctaaaatctttcctttatgtctatgtcaatatattagtaaaggttataatttggggaagaggattggtgagatggagtattggtgttgaggaagtttcactttttaatttataaagttctaaaatgttcaattttttataggcacatattacttttataataacacattttttaaaagtttcctttataccttcataaaggataaattttcacctgtaagacaagaaatcaggtgaaaagagattttcacctataagaaaagcactgagatccatccttcttcagatttatggataactccatgcaatttagtctcctaacctatgcacctagatctggcctgagttttccaaaaactaattcaaatccttctcgtttcagtcattgaatccttcagatcagtcatatttaacatagcattctatttaatatctggaacatcactatcacatttttagtattgtaatgataattataatattaagaaagattatagccagtcagaggcaagaaaaatgcatcaagaagttcagaagagctgtttttctcagtccttctattggttcaattggtttgagtacagatttcattaacagatccctgaaaatatgaaatacaagccactcagatggtagagatgtggacttcaaaagcaatcagctactgaccttccagttgctgaatggtctgggctgactgaactgcttgctcattcttatcttggagaagctttgaattttgatcctttagagcatcacaggcagactgcagctcttgtccagtcttttgaagactcaaaatatgagaggtcttctcttccatttctgctttgtgcttctgctccaaagcactataccgagactctagttcagcctgggcttggcctgcttgctcaaactgttctaaaagatgatgcatttcttcctgcagattatggaaggataattttctctctgccacttcaagttccatcttttccagtagaatcttggactcctctctttctgtttccacagtgttcctcaaagtattatgctcagcttccatctgctgtaactgctgagagagaatctaagaaaaaagacaaagtctcatgagccataaatacattatttcatttcaacaagcattgtaaagtgctttttcttataggatggaaaaaaatgggaacatgtttctatgctagagagaaagcccttctcaagaaggagagttgaaaattaagaagagaggagatggctgactccccagcagcacacaggcacccagaaaaacaaacagagaatgtggactatagcaccaattctgcattatgatgagactacttggatgtgacaggataggaacacaaggaatccaaggggtagaaaaaaggtagttcaaactgtcaagcatgggtccatataggacacagaaaggagcaagggtaaggaagaattaacatactagagaagcaaagtggaattcaatggaattcaatgagaatgaagatcaggacaatatgagaaagaaaatggcaggatggattatagtcagatcagcattactgattaccttcatactcaagagaatattgcagaacgagatcatttcaatctaacagaaggtcaatttacaaaaacaagaaaagatgggctgtacataaagcacaaaaaccattcaagacagagaagagtaactgatgaaaaagaaactcactaaaggataatacaggtcaagtatcccttattctaaatgcttgggaccagaagtattttagttttccatttttttcagatggtggaatatcttggatatcttgggataggacgcaagtctaaacatgaaattcatttgtttcatatacatcgtatacacatagcctaaagataattttatacagtattttaaatgattttgtgcatatttgcctttgatctgttaccctgttccacaaggtcagttgtggcattttccacttgtggtgtcatgttggtgctcagaaaatttcagattttgcagcattttggattttcagattaggcatactcaatctgtatgacattctagataaactaggaccctagatctaaaatggcaaagggaaagagcaacaataaagaagtgcaatgtatgctccatgagggaaagaactgtatttagttttgctcataattgtactgcatccccaccacttaagtacgaggtatttgttgaaagaatgaataaatggcatcaattctctgaagactttaaataggcttttatatctactgcctggcaaacgaaagtggaaatgaataccctccaaggcaggaagtaaagattaaaaggcagtacctggtttctctgctcagcagcagtcagctcctgttgcagcaagtcaacgacctgagcacggcccaccaaggattcttcgtgttcctcaagcttcctttgcagcaccctcaatttctgagaagaaaacattttagacataatatgctaacaaatgagtgcttgtatttgcttatctttcaaaatgtcatgtagatttgtatacttaaattttggggtgttgaaaatgacagtttaaagagtgggagaccagcatgccatgctccccccatccagcagcaacgaagagtctccaaaatgtcttctccagagcaccaacaacaaccagacccagacacaagcaagtccctgaattagggagtctctttaaaaattagaaaaaacaataacacatatctgccttcaaaatcatacagttaataacctgtacctagatagcataggtacatgtacatcttacccacccaagagaacattctctgcaggcaagaatcatttctcttctcctagtttcatgcactgggcaggcacttgaaaaaaaattgttgaataaataaagcaatgatacacatatacaattagtattctacttaataatatgttgtattctaaaactttatttagtggtgcattctgaaagattgcttagaacttaaaagtttccgttctaattaattctaattaattttcaatctaattaaacagatcaaacataaagtatcactgaagtgcctttcagtaccacaatgcactacacactaagtgaaataaaatactttgagttagtagatggtgaactcaaatacaatgaagccaattttcaaaatctactcaaatttttttaaaaaagaattactgatctaataaaagacttcatgtcttcaaaatcattctttgtcttctctaattttttaaatatttaaaactgacttcattgatttgaagctttgggttaggtgtgtaatgcacaaaggtagctataatcagaaaactgaagagaaaccaatttttgactaccacataaattcaccaactaaactcagcttttgagcaccaacaacctgattagaggggtaaaaggcaagaaaaggataagaaaaaataaataatttttatgcaacagaagacaaggacacaaaagaggccaataaggaaaacactaacaccaagtgaagagcagtgggtaagggtaggaaattggctgtgatggattaaatattaaccaaaatgacagtcattctaccgagttttagcaacacacctgttgcatctctgtttccacatctgcctgggttactaactgaagaagctcatcttcatgaagacgaacttgtgtttcaaagcgggcatctttctctcggaccacctgctgcatggaactcaactgaagacacataccagagaaactatgcaagttacactccccgaatattgcacaaataaaactcacagactactttccaagacagacactgagacttgatagtagctttttaaagtgaaattttgattgtcaaggatgaggatgttggaagagagataggctggacagtaactatgaaatgcgagagaaagcctattttcaaattcagaagttagcctaaacataaattttgatcaaaaattatatgttcatggttactagaaatgttttaaatatacaagaagtgtattttttaaagttctaaaaagattaagatattaaacacataaggtgaagttaagttagatttctattaaaccctggacacttcttgctcatggctgaaaagctttcagtaaaattctcatgccctataaatgaaaattcaaactaacatatcatttattcaagattctctacaactggaaataccaatctatctttctagtcttattttcaaagaattgcttctaccaaagaacctcatgtgcttctaaatccacaccacctccccagacagctgttttcagctgtcattacttgcagccttctagatcatgctcatttttaactggctctgaacagaatgaaatggaaataaatggactgatggtgagctgctcagtatcagtgcttctgtcttgtttttaggttgtgagtgtgtgcatctgcttattcatctccttaagatctatggtggagcatgctgcttagctgttagcttgcctattttgcattggtcctttactgctgatatctcagtttgtgacaccttgaatcaaactttggctttcttttttggtaggagaaaaacaaatcctcagaatgtttttattatctgaattgtgacctcactaggaatttggactcttgtgtttcaagtgtgtaggcactggagtctttcattagccaaacatctctaactcctttcccataactgttccatattcttttccttctctgcagttttgctcacaccgttccccatcactgaaatatctcccccagcttgtctggaatattatctatatatcatggttttgcctaaatcccaacttttccgtgtaattttccttaactgtcaaactcacagtaacctctttcgccttccaaaatattttgtttgtattgctgcttgctttggcacttattcggaaagccttaaattacgatgaatctcttaacacatgtatgtatcttggctttccatattttagcaacacataggttaaaaaccatattttgtatttcttcatcctgcactgtatatagtgcttatacataaaaaggacacaataaaaaataaataaaaaatttaaaaaggacacaataaaagctaataggtaaaaccaagaatttcaggatatacaattttaactgtatacatagcagtaggccaaccacagagagaaggcactactaatactacaaattattaataaagtaaacacctaatggataattagctatgtacaaaggtacttcagggaaaaaaatctttcatgattcataagcattcccccaccgctgcccccaccccccaaaaaaaattacagtgcctgtaatcccagcactttgggaggccgaggtgtgaggatcacttgaactcaggagtgcaaggcctgcctgggcaacatattgagaacctgtctcttcaaaaaatgtaaaaaatttagccagatgcagtggcacatgcctgtagtcccagctacttgggaagctgaggtgagtgagaggatggcttgagcccaggagactgaggctgcagtgagctatgattgtaccacttgtactccagcttgggcaacagagtgagacccaatttcaaaaataaatatgtgggagtgcgtggccaaccaagaaacctagaaaaatagaaaaagttgaggatgccaatccaaatggtctggtcttgacagatgaaaaaaatgggaagaagaatgtcacatactggtgccatttaacataaaatcacatgacctacaccactttctcattacaggctcactaagtaatctaactataatttatttcctattaagatagatattattttgggaaagaatgaacctaattatttttatttcttttggtttacttattggtctcttttgaactcagcatgagtccattcccaaaagactgaatctctgtctgctattaaaattaagtttctggacatgcagaactaagaaacagtcatcaattaggctatagaaaattcatcaaggtaaataacacattgtgaggttttctggtgttccctaatgacacacttacctaccacacatctcctaatctcttctactacatatccttctaatttctagtgcaacacccatgctactatacttttatctactaggattttttaaagtgactcactgaattgacttgtgcgtaataacccactggacttcatagctctttatcctaattttgtgaggtccctacctgtgcagcttgctctgcctgtgtctggctgagctgggcttgtaaagtgctaatgaattcttccttctcctggagctgttgcttcatcattacaaattcttccatctctgtagaactcttatcaaaccgaagacatagaaggaaaaaaaattatttaagcaaaagaatgagcattattaattctttgacctccctttcttgcttaacctaaatgcctaccatatttccttctagtttccattgaacccaaaaggaaattgcatgcattatcaaaattttatttgtcagaagaagacagaagcagtagtggcaatttttcaatttctctgactcctcacatagagacagcacaagatagtaaaaccaaaaaaaccacagataacatttacagttaaattaggcagaccgtcctaaaaaccctaaaatataagctaataaggacaaaccaccaaaacccacaagaactacattgtattagagtcttacattgtgtaagaaaaagaaggcagcaaaagagtgaaatctgatgggtctgagaaagggacagccctaaacagccaatgtatttatttgctggaatgaacagctggccaattttagaatagtggcagggctttgccattctttaatactaggtaaatgcaaggggtgcacagtaaggtaagaaggactaaaagggctagagcaatctaggccccctgaactctcacaactgactcatcatggctcccttctgagacatgaacctgtactaagaagaaactgcgaggagtgaaataaaaattatgcagaaaaggaattaaagagacagaagaaagaggtctacaaacgtattgtataattcagtatcaactagccacatgtggatatagagggcttaaaatgggtctgatagaaaagaaatatttttaatttttaacattatttaattttaatttgaaaactgaaatatagattatttttccattaagtacaactttgttttggcatgactatatttcatcttatctgttgcatcatgtaagttactgttgaggtgctgcacaagcaacaagtgtatatgcagttggtatcaatgggttgattcagtttaacatttttctagacccctatataacactgtaatatgtttatttgtatacttaatgcagacagcattagtaacagttgataccaatttaatcataactaataattaaattgcaatataaacatttattataattgaattattttccaagttcaaaaataaatatagacacatttcaaaatttaaaatgaaggccttctattgttgtatagttggttccttttcacttctaagtagtattccagtgtgtggatataccacagtttaaatatttccctattgatgggcatgtgagttgtttccagtctttaattattacaaataaacctattactattggacagtgctggcataaaccaagtgaagggcagaaggaagaaagccaggaaatctcagaaatccggctcccatatctttgaacacaacacaaaaacaatagaaaaaggaagtctgttaagaaaagctttcctgaatcaagcctccttccaaatagaggtttaggagaataaatttgacacaaaaataaggaacagaaaaggatgaaggtcatatcccatttaagttactattaaaaaaacagagtagcccccactagcaagaggaccctcaccagatgcagcctctcacccttggtcttctcagcctccataacttcttataaattacccagtttcaggtattctgttacacgcaagagaaaacggactaaaaaggaaaattggtattgacaagtggggtcatcgttgataatgattatttgaaaatgtggaagcagttttggaactgggtaatgggcagaggctggaaaaattctgaggaactagctcaaaaaaaaaatgcctagattctgatgagggcttagaagataagacaactacagaaagcttagcactccttggagattggttaagcggttgtgaccacaatgctgatagaaacataaatagtaaagcccattctggtgaggcttcagacagaaatgaggaacaaagtatcagaaactagagtaaagcccagccttgctataaattagcaatgaacttggctgaacttgtccagtttttgtatggccaagaactttgtagaaggctgagcttgagagtgatgaactagggtatatggcaggagaaaattttaagcagcaaactgcttgagctgctatgtggttacttctatctgcttacagtgaacagagaaaaagaaaacagagcaaaaaaaaaaaaaattggaaaatttgcaacctggccatgtggtaaagaatggagaagatttcaggatgggaatccaagaaggcacagccaccacttgctaaagaaattaacacggctaaaagggagccagtttctaacagttaagacaatgggaaaaagccctaaaggcatttcagaatgcattttagaaatctttaaggctgccccaacagcccccatcacaggcccaaagccctaagaggacagaatggtttctgtgaataggccctgagataccactgctctgtgccacttcaggatactgctccttgcagcccagctgttctggttagtgcaaagcagccgcaggtatggctcatgtcacagctcaaaaggtacgagttgtaaaacttggtaacatccacatggtgctaattctgcaggctcacagaaagcaagagctgtggaggcttggtagtctccacttacatgtcgaaggatgtcatcaatagccagggggctcaggcagaggcttgtcttgaggcagaaccaccacagagagccccactagagcaatgccaaggggaaatgaggggttggaattgccctgcagagtccccactagagtaatgcctagtggaatcacggtgtgggactaccactgccataccagaactatagagctaccagtgtgcaatgcaaagtcagcctgggaatgctggctggactaagcccagcaaagccatagggacagaactgcctgaggtcttggggacccaacccctgtaccggcagaggatgctgaaaatggagtaaaagaagattattctggaattttaaggcccaatgtctactctcttggttttcaaacttgcttggggtctgttactctctttcttcttgcctagttctcccttttagaatgagaatgtgaaccctatgcttgtcctaccattgtatcttggaggaagataatgtgtttttatttcacaggctcacagaaattggtgcaggaatgagctaagactttggggctgtggggatgcaattaatgtatttgtatgtgagaagaatatgagttttggagagccaagggtggaaggctatgatgtgaatgtcccctccaaaactcacgttgaaactgaatccccagtgtgacaagaggcctttaagaaaggactggttcaggaggtctctgaactcagcaatggattaacacattcacagattaatggattaatgggttgtcatagaaggggaactggtagctttataagaagaagagagacctgagctggcaaattagcacactcagccccctcactatgtgatgacttgcgctgccttgcgacaccactgagagccctatcagcaagaagaccctcaccagatgcagtccctcaactttagacttctcagcctccataaatgtaagaaataaatttatttaaattaaattaaatttctgttattataaattaaaaacaaaactaaggagcagaatgatatgattataggtgataaaagcataccagagccacactaaaaaaaaaaaaatcaaaattgcaatctatttcaaaaagtttttaaaaattaagaaaattatacaggccaggcatggtggctcacacctgtaataccagcactttgggaggcccaggcaggtggatcacttgaggtcaggagttccagaccagcctagctaacatggtgaaaccccatttctactaaaaatacaaaaaattagccaggcatggtggtgcatgcctgtaatcccagctactcaggaggctgaggcaggagaattgcttgaacctggcaagcagaggttacagagagctgagactgtactgctccactccagcctggccaacagagtgacaccctgtctcaaaaaaaaaaaaaaaaaaaaagaaaagaaaagaaaaaaaaattatacagagatgagagaaaaacataaatcagatttagaaaaatcagaaatgaggtgactgaactcatgaaaaatccaatagaaaagaaaaaatcattgcagtatagaagataaaaaaacagaaaaaacacaaaaacaaacaaaaaatagaaggcctaaagtgaaataaaacaacaaacaaaaaaacaaacttaaaatatgtgaaaccatatattgaaagagtatactgggtatctatgaataacaactaaaaatgacaaacaccaatgcatattctaataaaattaccagacaagaagaaatgaagaaaagaaggagactgatatatacatagataaatgcccattgtgcatctagaaaaatgtatttgtcacataataatccattggttttagtgattcattaacctaatgattatgaagtaacttccacccctacctgtgcaggttgttctgcctgtgcctgagtaagctgggcttgcaaagtgctgattagttcctccttctcctggagcttatgttttatcttttctatttccatctcttcctctgtagaactcttgtcatgctgaaaatgcaggagataaagtcattatttaaaagaattacaattaatatatatttgatattttcttctaatttttcatttacaaccatttagttataattttattaaactgatgggagcaagaaaaaccagctgatctaacaaataagaaatcttagggttgtccagtttttgtatggccaagcagttcctgttagacctaccctccctcacataatagctataaactgtgaaatacatacacacacacacatatatatatatatatatatatatatattttttttttttttttttttttttttttccctcacaccaagcatgtgaacccaaaactgtggacaatatagaaaacagctatctgaaaatactggagagcaaccaaaagcaggaagatactggaggggatgtgataattggaagaaatggtaccgagtttcccattttgacagcttttattctgagggcaaaaccagtcagtgccatgcaggactaaaccttaatagaaaacccgaagtcttgttgccttgaagaatcaaggagagagctcaggaaactatagctgttgctaagtgagaagcaacacatcagaaaagagccagtgaggggaaatccaattttttcaataatctatttttttttccaaaagctctcccttagactgagattctgcctctttgtaaatttagtccctcccaaccccctaaacaaagctatttctgcttactggaattacaaagaatacttttatactttcacataagtcagtcaagcacctgaggactgttgtcatttcttcaactatactttccacagaatacctagctctgtattgagtatataatagttaaagggttgctatgactgattgctgaaacttagaaatcatttctttaacagagaaagaaaatgaactctaagacattactgctttaaggtctcagagctaaaaatgaaattaaaaagcagagtataaaatggataatttaaaaatctgacatcatagctgaggagaagctggagggaacaaagcaatatgaggagagaggttggtgctaccacagtgaggggaagagaactgacagaggaaaaaccaaaaggaaaagaaggatcaaggtgaaattatttgagaagattgagaaaagcttttaaaataggcttcaagaagttaaataagattatcaattcagggaaagtaatgttctctgatcattaggccctgagaggaaagactaagcaggaactgggtcactaactagcgatcccaaaggttgtgcctagaaaactgattaaaatctcatttcccaagaactaaggatactagcaggtcaaagcaaaacaaaatgaaactaaaaaaataaaaagatttcttacacacggtgaagtctaggctcactctataactacagtatgcatgtgatatgcctgcctccatataatctgtatcaaactctccacaaaactgaagtttcttgttctctaaatagctgactgaatgtgaatatgtggagtttaaccatacaggaaagataatgaaaatttgagtactgggacaatattcctcacagggcagtactttccttattcctcctctgtatctccaaccttaaactgctttgttggctgcagtcataaacctagtgagcctcccttttagagagtcccaggtaattcagctgattcagcccacatgcatgaagctttaatccaccactatgtgactatatatgaggacacagaatattctgtgttaagtcattgaattaaaaagtttcagagctggaagaaaccttagagataatctagtttaatcttctaatcaatgatgaaactcctccaaaaggtatgtttccctcctctctaaatgcctcacttcagtacttatttcttcctgtaagccttttttaatccctgaaagtccaggtcacaactggcatttcatatccatgttttctgtacatctttcattctccctgtgtgtggcctacagtccagctgaactacaagctctataagaaaaaaaaaaacaaaacattatttagtgctgtatcattttagcatcctaaatgtttgtgattggtgaagatctgctgtattggtaggttttttcaacttaggaaatatacactacacccagtcaccataccttggaaagttgctcctctgactgaggttctgtaggcagaacagtccctccttgtgctttcatttcttctatgtatttattcaaagaagttaatttggccttcgcatgaagttttagttttttaattttgttatcagcagcttttctctcttcctgcccaaaaacaatgatggtaaatacataaatgtttattcccctcttatctagcacatactaaaagttatttttattattattactttcagagacagggtatctctctgttaccagggctggagtgcagtggcacaatcacaactcactgcagcctctaactcccaggctcaagcgatcctatctcagcctccagagtagctgggactacaggtgcccaataccatgcccagctaattttttttaaatttttttttgtggagacagggtctcactatgttgcccaggctgatctcgaactcctggcctcaagaaatcctcccatctcagcctcccaaaatgctgggattacaggtgtgagctaccacaccgacccaaaagttattttcagtaggcataaggttacagtactagggagataatcagattccctaataatctaagtggagacaaaaattaaagtgagtagtgtatcatctgtcctttatcaaatgctccacaagaaaggataaaaacaatagtacctgtagagcttcatctttctgctgcagttgaacatccttctgtctaataatatcttttagctccaccaccaattgctctgcataagccaggcgctcctgaacatcttcttgtgtagtattattaaattccatgtcagattcttggtgtaattcctaatatttaggaaaaaagttgccagtgcaccaggaaaaggtattagcttcccaacaggagtttcttcattccaactttttatgttttgcccaattcatattcttgttaacttaagaatctaactctgatccaataataatcattatcatagccattacaatatattaagtattttataaatgttaagcattttacaaacattatcccatttaaggtattattatcctaattttaccaaagagaaaaataaaggaaagcaaaaatcataaaccagtaagggtaaaaggccaaaagttaaaattaagagtagttaagtaaaactctcttaaccactacgcattacttcttgtcttttcagaaaactaagaagttttattaattccttatgtggacttcagaaaatataatacatactgccaatttgtatcatcttaaaaaaaaaagaaaatacaatacaaactataggagaagtggtaaatgaaattacaaagcaaacagatattctgaaacccaaaaggtgttccagtttcctcatttgtcacttagacctttcctgtggaaaaggaatagccaaggatgagaacaaaggacttaaaacactctggcaccaaacaaggcccagggagacaaatgagaaagccctttcaaattgtatccaggacttgtttcccatcactgtggcttttaagctaaaaacttacaagagaaggatcacttataaaatttcaatatttttcttaatcctcgcttcacctagtaccagggaggcttcgcacacccttctatcttaaattattttccttagaagaacacagaacatatgtcttaccagtttaaatcagaacagaactactcacagggtctaggggagccctcatattctgatcagtgtcatcatctcctgataattcatgcaaaacaacatttgctaatcctgataatcggctcagcatttctgtaggaaaagaaggggggaaaaaacctaagaatcagcaaaatgaacataggcttctcctatattgataaccatatcatccgtgaatgaaaaaagaatactgtacaggtgatttgtattagacacagtctgcagcacaatgatgtcttcaaaaaggcatttgagtacttccagtgtagtcacacgctgttcttttcagtggcaattgtacagaggttatcaccatcactaacaccatttctaaaataaaatgtaagtacctaatcgttaaacattaatacaatgttaaataccaatctataattgttaaatacaccttaaaggtagtttttatctttaatgcccttctttcatagtagtttcacttacaaacatgaatttcttttttctttttctttttttttttttgagacagggtcttgctctgtcacgcaggctggagtacagggacgcaatctcagcccactgcaacctctgctttctgggctcaagcgatcctgccacctcagcctttcgagtagctgagactacaggcacatgcccaaacatgaatgtcttattctttcttcctctgtcagactgttattctctcccacttgttcaaataaactccatgatactgcaacatttttctttttatgtgccccatgaaccccattctttcagaaagctttcttgataaaccatgtggctttgctaaaatttaaatataaactttgttcaaaatgtacagcattaaatgcatatattagaaaaggaggaaggacagaaatcagtaacctatgattcttctatagaaaattagaaaaagaagaacaaattacagccagtgtaagcagaaaaataaaaataaaaatcagagtagaaattaataaaaatagaaaaatagagaatatcaataaaaccaaaagttgattatctgaaaagatcaataaaattgataaaactctagtcaagatgaccaagaaaaaaacagagaagacacaaattactggcatcataaatgaaagaggaaacatcattaatgatctaacatacattaaaagataataaacactacaaatagccctatacttttaagttcatccatgtagataaaatgggtcagttcactgaaagattcaagctaccaaaagctcaagaagaaatagagaacctgaatataaatgagtagatatgtgtgggtgcatgtgtgtgtacagacacacacacacatatatatacacacatataaatatgaaattgaattcatacattaaaaaccttctaaaaaaagaaaactccagatcaaggtggcttcattagtaggtaacaagaaacatttaaggaataataccaattttatataatctatgccagaagatagaaaaggaaggaacaccttctaacttattttaccagactagcattgccctaatactaaaagcagacaaagatattacaagaaaactaaagaccaatgttcctcatggtcacagtcaacaaaatattcaaatagtccataaaatattagctaattaaatccagtaatatataaaaagataatacatcacaaccaagtggggttcaagaaatgtaatgctaattcaaaatatgaaaatcaatgtaattcaccatattaacagactaaataaggaaaaccacataatgtcaatagattgagaaaaagcatttgacacatttcaatatctattcatgattatgaattcacaataagaataattcattctcagcaaactaagaagtgaatttcctcaacctaataaagggcatctttaaaaaacttacagccaacatcataattaatggtgagaaactgaatgttctcaccatatgagaaacaaggcaaagatgtctcttactacttctatctaacactatactggaagtcccagccaatgcaacaagcaagaaaaagaaaagaaatacaaattggaaaggaagaaataaaactgtctcaactagcaaaatgattgtccatgtagactttccttaaaaaacaactcctagaataagtgaattcagcaaggttgcaggatacaaagtcactatataaaagtcaactgcaggccaggtgcggtagctcacgcctgtaatcccagcactttgggaggccagggcgggcggatcacgaggtcaggagatcgacaccatcttggctaacactgtgaaactccaactctactaaaaatacaaaaaattagccgggtgtggttgtgggtgcctgtagtcccagctactctggaggctgaggcaggagaatggcgtgaacccaggaggtggagcttgcagtgagcctagattgctccgtctcaaaaaaaaaaaaaaaaaaaaaaagtcaactgcattcccattacaatgaacaagaggaatttgaaaccaataagaataccatttacaacagcactgaataaacagagcaggacttgggtaaacagctaacaaaatatatgcagaatttgctgaatgctgaaaactattgaaaacccgaggaagacataaaaaatctaaataaatgtagaaataaaacatatacatgtatttgaactctataatgttaaagtatcaattctccccattttgacctataaaattagtgcaattccaaacttaatcccagcaagcttttagtaaacatcaaaaagctgactctaaaacatatgaaaaggcaaggagtgtggaaattactcactacaattacaagacagggcagcactggtgaaagcatagacacacagataaatggaacaaaatggagagcctagaaatagacacatacaaatcgagtcaactgatttttaacaaaggtacaaatgcaattaagttgagaaaggacaatcttttcaataaatggttgtggaacaattggacatctgaaaaagagtgaaccttgacatacaactcacaccttatacaaagcatatctcaaaatggatcagagacctaaacttaaattgtaaaggttttagaaataaacataggagaacatttttgtgacgctgaatttggcaatgagcttttagacaccaaaaaagcacaatatattataaaaaatattgattaaaaatttatcaaaacatacaacttttgctctgtgaagacaaggttaagaaaatgaaaagacaagtcactgaagccaggcgtggtggctcacacctgtaatcccagcactttgggaggctgaggcaagcagatcagttgaggccaggagttcaacaccagcctggccaacatggcaaaaccccacctctactaaaaatacaaaaataagctgggcatgatggcgcatgcctgtagtcccagctactcaggaggctgaggcacaagaatcggttgaacctggaaggcatggattgcagtgagctgagatcatgccactgcactccagtctaggcaacagagcaagactctgtctcgggaaaaaaaaaaaaaaaaaaacaagtcatagattaggagaaaatatttacaaatagcatatccagtaaataacttgtatccagaatctaaaacaataaaaatatcttaaaactcaacatcaataaagtaacacacctgataaagaaatgtgcaagagatgtgaatagatacttcaccaaagaagatagatggatggtaaataaatatatgaaaagatgcttaagttaatctggcattaggaaaatactcattaaaagcaaaatgaaataccactatctacctattagaattgctaaaatatgtattttttaatgctggcagggatatagagcaacaggaactttcaatgcctgcagattagaatacaaaatggcacagctacttcggaaaactgtttgacagtttctttaaaagttaaacgtacatttaccaatcccactcctaggcatctaaccaagtttatagtaggtttactcataatcacagattctgaaaatagccaagatatccctcaacaagtgaatgaataacaaactgtagcacatccaaacaatggaatactactcagcaaaagaatgaacaattgattcacacaacacaatacttaaacctaaaatgccttttgctacatggaataagctaaacattaaaagatatacatcatattattctatttatataacattttgaacaagtccagaaattaacccacacaaatatagttgtcagggcttgagggaaggagatgtggctgaatataaaagagcaacacaagggaatttttaaggtgaaggaactgttctgtatgatcttgaagtagtaaattcataaccatatgcatttgtcaaaactcactgaactgtacattccaaagagcaaacataattgtatacaatttttttaaaacctcagccaggatgtcaggagttccaaaaatggaatgcagactgtgacaaatagatctaactatattataaatatatgatataacctcactgaaggagatggggctaacctaagaaacaaaaatggtgttttgactgggtactataaggataaagacaaaaagaactgacataaacactgtactctgcttggtaaatttctttctcacagtggtatgggttagcaattctgaaactacttcattgtacactagggttaaatgagtaagtaaattgtagataatgagattcaggttttttactgtcagtgaaagaagttacaaataaggcaagaaagctaggataaaccccatggtactggattagagtcagagatatcagtatgaactcatgtttattttaatatatatgtaaatagataaatgcagaaataagtatagatatgtatgcattataaataatcagttattacagagaaatatatattctagccgtgtccactgaaaagtcctagaaacagtaacacctcagtagcaatgagcgcatccagatctcgatttctaaattgccaatctccaataaaaggaactagggctccttggagaaatggctgcctatctagggttggggcagagagccagaaagtaaggaagtgttcaaaaaagaaaaagaaaaaaaatggggtatgtgaccaggagccaatctgaaggagctcccaatgatcaaggctagaataatttgagtcacagaataaataacaataatattggattatatggattataacccaaataaaaaattaaatacccatcagtcaatactgatataaataaatcattaaataaattaatggtagagacaaatcttccttacaaaagaattccaaataatttatgtagatacgtccccctctaaaaatggagcttaattccctctccttcagtataggctggacctagtgactcacttccaaagaatagaatatgaaaaaagaaaaacagcaacatcagagtggtgagacttggcaaccaccacctcaaccaagtgatcaagattaacatcaccagtgataagtcatcgtaatatcatgtaacccctgatataatgtgatgagaagggtactttacctctggggtattcttctgcaaaacccgtaagcccagtctaatcatgagaaaacactgggaaaacctagattcagggacattctaaaaatacctgaccaatactcttcaaaactgtcaaagtaatgaaaaacaacaaaaaactaagaaacagtcacagattagagaagacaaggagacatgctgattaaatgcaaagtaggccgggcacagtgtctcacgcctgtaatcctggcactttgggaggccgaggcaggcagatcacttgaggtcagtagttcgagaccagcctggccaacatggtgaaactccgtctctactaaaaaatacaaaaattagccgggtgtggtggcatgcacctgtagtcccagctattgggtagtctgagatgggagaatcacttgaacctgggagacagaggttgcagtgagctgagatcgcaccactgcactccagcctgggtgccagagtgagaccctgcctctaaataaataaataaataaacgcaaggcagtatcctggattaggttctgaaacacaataaggacattactggaaaaaatggtgaaatctgaatgaagtctacctatagtttagtttatggcattgcacctatgttctctgttttgaaaaagctaccatggttgtgtaaaatgctaacattagaggatgctttgtgtatacaataactgtctgtctaatcttcccaagttgtatgtaaatctaaggttattccaaaatcaatttacttttataaccactgtgtaggctacatattcagatcagtgtcaactgctagtccataaagtccatgaaaatgagaagcatattaatgctttgataggaaaaatcaaaatagaactggactatgcatagcattagtttacgtgattatgcctaattttacattttgtgataaaatgttatttggcttttaaaaccctcagcaggggccgggcgtggtggctcatgcctgtaatcccagcactttgggaggctgaggcgggtggatcacgaggtcaggagtttgagaccagtctgaccaacatggtgaaatcccgtctctactaaaaatacaaaaattagccgggtgtggtggcacgtgcctgtaatcccagctactcaggaggctgaggcagacgaatcacttgaacctgagaggtggaggttgcagtgagccaagattcgcaccactgcactccagcctgggcaacagagcaagaccgcgtctcaaaaaaaaaaaaaaacctcagcaagaagaaatataaaaactattgtacaaaataaacacttaaatgaaactaggctctgctacagttttcttctactggggataataatagtgtttagggcagccatggttcttaagaaagaagtgatgagagatacctgtttttttaatagattgtcttgggtaatctaagtagcacatcacttggaaaagatacgtgagacagaaatagaaaaagtgaactgttccctaggaaggcagcgcaggatcatatataacttcatatctaaatactggaagggcaacacagtgtcatacatgagtacatagggccatatataactatttattcaagatatgagaaccacagctatagtcaggattaaaaaatcacaattcagcagtatacagattctaaactttcttttcaactttagagatcatattttctttggttaacttttaatgaaggaaatgaataccatcactaaagagtttcttaaacatatagatttctgctaatcaaagaaaatcataatggaacctaacttatcaaacagaatcactttatcttcagatttttcagaccactttggaacaaagaaaacaaaataaccaactgatgggattctgagaagatgggagtagcaaggggccccatggattttgtatcttcctttattcccacataaaaacagacaaagcaactaggtaacaaaagatccatggacagcctttaccaaaaaactacttaacaaagtttcctacaaaccccaaaataaacgtggatatagacaaaccgccaatagtcaaaagatctgggtgtcactggtgttcaactgggaggaaattgagggaagccagaggagtacaacaccaagaggacctcaaaagagccagtgggcattcactggcaaatgcgccaagccaattacagaacagtagttgatacaaggaggggtcttcccattccaataacaggtacctgccaggggcctacgagggctgaaagagctgaggcagtctggacctttattaattctcagaactgaagagttggggctctcttccaggatagggtcccacactgaggagaatctgctgagaggagaattaaaattaagtgactaaggaaagaggaggtccagataaagagcaggtgaaagtggcaaggaaagaaaggcaggaaatccgagaaatccagctgccatatagttgaacaatgtctgaaaatagcacaagaggaaaccttatcaagttagaaaagctgtataaaatctctttctaaaagttcagcaacactaaattcatattaaaaatgaactactgaggccaggcgtgctagctcatcctgtaatcctagcactttgggaggctgaggtgggaggatcacttgagcctaggagttcaagactagcctgagcaacatagcaagatcccatctctacaaaatttttttaaaaagtcagccaggcatggtggcacatgcatgtaggtccagctattcaggtggctgacgtgggaagactgcttgagcccaagaggtggaggctgcagtgagccataatcacacccctacactccagcctgggtgatagagtaagaccctgtcacaaaaaagaaaaaaagagcaactgaaaagtctcacaattcagatacattactagaagaaaaaaaaggaggaaaacgatcatgataacatcccgacagaaaatggaagcacgtcagagagccatgctcaaaaaaacagttcaaaactataaccacttaaatctactgaaggaactaaaaggcattaaaaatgacataagatgtgaaaaaataaacatcagaaatagaaaaacccagaaataaagtgaaaacaagaagtgactgaaaaatttaaaaaatcattttggaaatgaagatgaaactagaaggaacaagaaaatgagtaaatataacaaaccatgtcattaaaaaaaagcaaagttgaaatgaaggataattttaaaaatcaaaaagaaatgacctaaaaaactagatatgcaactaccttatgaccctcaattccactccccagcatttatcttagagaaaagaaaacttaagttcacaagagaacctgctgtatataaacattcatagcagctttatttctattaatagacggttaagcaaactgatatatacaggcaaatggttaaacaaactggtacatacatcccatcacatacttctcagaaataaaaagcaacgaactactgatggacccaacaacttagatggatctccagaaaattacattgaatgaaaaaaagccagtcccaaaaggttacatattatacaattccatacttctataacatttttgaaatgacaaaattttagaaatggaggaaagatgagtgattaccagtggttagagaggggttggggtgggaagtgactgtggtcataacaaggcaacacaagggatccttgtggtgttgcagctgttcaatatcttgactgtggcagtggatacaggaacctacacaggtgatataacactgcaaaacttaatgatacacatacatacatatacaaatgaatatacaagtaaaactggggaatatatctatctcaatatcctaattgtgatattatgtattagttttgcaaaatgttaccactggaagaaacaacaaagtgtataaaagagctctgattatttcctacaactgcatgtgactctacaattgtcttcatatttaaaaaacaaatgaaaaagaaatgaactaaatgcaacatgatatcctgaattgaatcctggaacagaaaatggacattaatggagaaactggtgaaatgtgaacaacgtctggagttcagttaatattaatgtaccaatgttggtttcttaattttgtacactgctaatgtcacatgttaatcttagggaatactaagcaaaggatacaccagacttctgcactatctttgcaaattttctgtagtaaactttctgtagtgatctgaaataattcctaataatttgtttatttttaaaaaatgtaagaaattaagagttacataggatttgcgagaaacagataaatattgaagataagtaatgtgaataacaggattccctgaagaagaaaagcaaagcaaagaaacagcacaaatatgaaaaaccataatccaagaatatttatttgaaaattttttttaaaaagatttgaaactacatcttgaaagagcccacaatgtacctcagaatgtcaactcagaatgaccaacaaaacactctagtaaaattactggacttaaaaaaatcctttaggctttaggctaaaagatcatatgaccagtaagataaagaaaaaaaagcactagatttttcaacagcaatgtttttgccagaaaaaaaaaatgagttacaaatttaagatattcaagaaaagaaaaagtgagccaaggattctatttctggcaaacacaaactttagatataaaaaacacagacaaaatgttatgaacgagcaagaaaattcatgaaatatgaatattcccttaagcctttcctaaagaatttactagaggcaaaacttgaggcaatccaaatgactaaagaaacatcattataagaactagtggtgagcattaaatatacggttactaacagaattaagactaagtaaagactggaggagagacagcatagtatgtaatgattatatgctctgacaatatataggacaaccatgaaaaaaaatcgggaagaatgtgaatagcatatgcaaaaaataaaaaatatttttaaacagttttcaataattaaaagtggttgttgtctacggccataccatcctgaacacacccgatctcgtctaaagtggttgtggtggtgatattcgtatcatcactcctagattactatatgtgaaatgtagaattaaagcaaatgataattatggatacactaattctgtattttcagttatgaaaagaagatacagatgtaatacagaagaaattaagaaccccgaaatacaaactaatctttgaatctgaataggaacactcagtgtgaaatgacaattcagtattttatatttgttcacatattttcctagctctgtccaccaaaaaggcttaaaagtaatgacaaactgagaagcaatgaatatctctagtgcctagattggggtcttgaaatactctttcccatttttaaaaaagtttttaaaagaaggttttcttagagaaatggctaattccatttctaaagtggaaatgtacaaaatgatcctgaaacatcttgtcatacaagataggaagctttcaaaggacacaggttcccattggctaaaaggataatttgaatatgtatgaataagaattacagcacactgggccatactgtccaaggtaatttatagattcaatgccatccccatcaagctaccaatgactttcttcacaaaattggaaaaaactactttaaagttcatatggaaccaaaaaagagcctgcatagccaagacaatcttaagcaaaaagaacaaagctggaggcatcacgctacctgacttcaaactatactacaaggcgacagtaagcaaaacagcatggtactggtaccaaaacacatacatagaccaatggaacagaacagagccctcagaaataacaccacacatctacaaccatctaatctttgacaaacctgacaaaaacaagaaatggggaaaggattccctatttaataaatggtgctgggaaaactggctagccatacgtagaaaggtgaaactggatcccttccttgcaccttatacaaaaattaattcaagatggattaaagacttaaatgttagacctaaaaccataaaaaaccctagaagaaaacctaggcaataccattcaggacataggcatgggcaaagacttcatgactaaaacaccaaaagcaatggcaaaaaaagccaaaatagacaaatgggatctaattaaactaaagagcttctgcacagcaaaagaaactaccatcagagtgaacaggcaacctacagaatgggataaaatttttgcaaactacccatctgacaaagggctaacatccagaacctacaaagaacttaaacaaatttacaagaaaaaaaataacaccatcaaaaagtgggcaaaggatatgaacagacacttctcaaaagaagacatttatgaagccaacagacacatggaaaaatgctcaccatcactggtcatcagagaaatgcaaatccaaactacaatgagataccatctcacaccagttagaatggcaatcattaaaaagtcaggaaacaacaggtgctggagaggttgtggaaaaataggaatgcttttacactattggtggtagtgtaaattagttcaaccattgtggaagacagtgtggcaattcctcaaggatcagaactagaaataccatttgacccagtgatcccattactgggtatatacccaaaggattataaatcatgctactataaagacatatacacatgtatgtttactgcagcactattcacaatagcaaagacttggaaccaatccaaatgtccatcaatgacagactggattaagaaaatgtggcacatatacaccatggaatactatgcagccataaaaaaggatgagttaatgtccttggcagggacatggatgaagctggaaaccatcattctcgccaaactatcacaaggacagaaatcaaacaccgcatgttctcactcataggtgggaattgaacaatgagaacacttggacacagggcagggaacataacacactgggacctgttggaggttgggggctggggaagggatagcattaggagaaatacctaatgtaaatgacgagttgatgggtgcaggaaaccaacatggcacatatatacctatgtaacaaacctgcacgttgtgcacatgtaccctagaacttaaagtataataaaaaaaatacagttaatcaaaattaatacctctaggaatacaaattataaatacacatatttccatggaaaaattataaaataagtcaccaatgctaaaacaccagaaatagttgctattagaaaactttaccaaattgtcaaaaatgagataatctaagtgctacagaagttgctgtttatattgctccaaaacatagaaaaagaaaatgaaaaattacaaaccatctccctatgaatactgatgacaacattctaataaattttaattagaatattaaataaaatattagcaaactaaatctgactagatactgaaaaatattatcaccaagtggatttattctagtaattcaaatatcattaattattatgaaatccattatggaaacccataccactaccacatgagtttctgattgaccctccctagaaaggagcgtgcccatcagcatcctactgaatatcattgaatatcatagcaaatgaggaacacatacacatgaacacaggataataatgataatattaatggcaacaattgagaaacatttaatttaaatgcaaagtgactgtaccactttatatactctttaatcttaacaaaatctgtaagataagtattatcatcatccccattttatagagggaaactgacactcagaaattaagacatttcaaggtccctcagttaaatatataatacaatagcagtcaggcagggtggctcacgcctgtaatcccagcaccttagaaggctgaggtgagaggatggcttgagctcaagagttcaagaccagcctgagcaacatagtgagactgtctctacaaaaaaaaaaaaaaaaaaaaaaatttaattagctgggcatactggcatatgcctgcagtcccagatattcgggaggctgaggcaggaggatcacttgagcccaggagtttgagagtgcagtcagctatgatcacaccactgcactccagcctgggcaacagaacaagaccttgtctcaaaaaaaaaaaaaaaaaaattaaaaagattgatagaataaaacaaaaagctatttaaaggaaaaatagattacttttctcacataaccatttaaaaatatgtacattttaagaaaggaaagactaatatttaaatgagataaaaatctgagagagtgctagagatgtactgttcaggcaggacaaaaggagtctctcatagattgattcaacagtctcagagatccacaggaaagcaggtgacatagtgggaagagcaccaaactggaagccaaggaactgagttttccgtcctggctcaataagaagctgcatcatagtgagtaagtcaccttaaagcgtcagtttcctcatcttaaaatgaagactaacaaggaccattctaatgccccctactctacagctgttgacattaaaggaataatctggaaatgtaaatggaagggcatctcacccacagttgtaggcttttggtagctcaaaggttgggaactacagggcaagaaagccagtaagtagccatgcttaagctaaatgaagaaagatgggtactcccctctattaggctcactgaggacagaaatgggcaaatgtatagataaaaattaataaaggggaaaatattcatagtcatagtcataaatctatgtatgtatatgtatatatacatatgtatacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtatacgtgtatgtatatatatacatatgtatacgtgtatgtatatgtatacatatatgtaaagattaataaaggggaatagtcatattcatagtcataaattcatgtaaggaatatgtatgactgttggacaatgttcttgctgttattttataaggcaccaaaataatgaatagcaactaaggaaaagaataaaacacagagcttcatgccaaggccagggattccataaaacactaaggcaaataaaacaattcctcagtctatgctggtcacagctttcacaaaccctgccacaggaccttaacacttatgtgttgaagtggcactcagaattaagtaagttttattttctccaagtcttcactgttatcaatgattattcttataacaaccacctggtgttcagcattatgctaggaactataaaaatataaaaagaattataaagcatgtccctagccaccgaaaacagaacaatatgcacaggaaaataagcaaaataactgaagacagtgagtgcatgcctgtgtatatatgcatatatgccatctactttggaatttaaatcacattttcccacagaaacacagagaaggtggttaggtttcagttgaggtgactcctcaaacttatttcatgcttatttagttaagcctcagtagctgtccttaattccttaaatctcaaagtgattttcaaccaagttgaggggctaatgggtagtgctgtatagctggaaataacacattcgatattatgacataattttacaattagaaaatgaacaactatttttcatgatgcagaagccactattttaattaaatgaatttgtaagtggtagctataacatacatacacagcgtgacctgccaaacactgctccaatatctttacacataacttacttttcgttatttaactcactttatttatttatttatttatttatttatttaatgttatttattttgagacggagtttcactattgtcgcccaggatggagtgcagtggcgcgatctcactacaatctctgcctcctgggttcaagcgattctcctgcctgagcctccccagtagctgggattactggtacccgctgccacgactggctaatttttggtatttttagtagagacaggggtttcaccatgttggccaggctggtctcaaactcctgactccaagtgatccactcgccttggcctcccaaagtgctgggattacaggcatgagccactgcgcccggcctaactcactttattcttaaaacaaccgcaagagggagtaccgtcaatattcccagttttaaggtgagtaaactaaggcagagggatgttaagtaatttccccagtcacatagttcgacaaagcttcttggtgggtgaagatacacagaaaatattttattttctgaataatctcattatccaatattctttactcgggttgaaaacagaatgaagggataaaggcactatgttaatagttaggtaagtacttttttttaaagcagtaagtaaactaaaatgattcatattagtatggccccaaataattccatattgtttataccacagacaggttcacacaagggccctaagatatatatacatggatgttatatatatatatatatatatatatatatatatatatatatatggatgttacataacaaaacatgttatgtatggatgttacataacaaaacaaaaatccatgtgtgtatatatatatgtatatatgtatatatgtatatatatgtgtatatatgtatatatgtatatatgtgtatatacgtatatatgtatatatatgtgtatatacgtatatatacgtatatgtctatatacgtatatatatacatatatacgtatatatatgtatatatatacatatatacacatggatgttatataacaaaacactacagcagtgttttgatggctaatgactgaaaatctaaatgtccatcaatggggacaggctaaatactatttttatatttttacaaaggactgctgtgtagccatggaaaggatgaggtagttttatacccatggatattgaaagtgcctaatatacagtactaaatggcaaaagcatgtgtattaggattccacttgtgggaaagacagaagggggtatatattatcatgtgctttattatgatcagaaagtttcttaaatataaccaagaaattatttacagtgcttacttctgggaagtggggaatggagatgggtagatcagtagatagaaaagaaaaagactttttttacattgtatccttctgtattaaatttccttttatcaaaagcatatagctgattttaaaatagcttaattaaaaatacagcaatatagagcttagtctccttttacataatggtttctaaccacagactggtatgtaatgatcagtggtattcctaatagtaattaacctagagaaattaatgaatgatttattttataaacaaggataaagtcaacatccctttaattaatccattaatcaaagggagaaaaagaaagggggcctataaaactcaagcagaaggttgaaaaaaatcttctaaagatcatgtttaagaaaggctgcatcccagagtctggatgccagaaatgccaacgaccttcttgaaaaacaaggaagtatctttacgtgattgtcaaattgggttgggaggtcccaaggtgtggacaaggctttttaaaaacttcattcttttacgtttatacttttgcatatttcatattatacacaacatatttacagtggtagtcatacactataaataattaaacacacaacatttggggagatgcatgctcaaaaatgttttactgatagggagtgcaattaaaaggtttggaagctgctgaggtagtaaaaaatattgatgcagtgaaaagaaaaacattaaatggtcattctgtggtcaagggatgagaagtaaaagctatgaagcagttaatgtacaatgcctgcaacttttgagtactcttcaactttttcctgcatctattccaaaaccaaatcctgccatttttccaataggatatttcctgagtttgccccttcataaccattctgaccatctaaatcttatcaattcacgcttttggaaaggcctctggcccttatgtaaagagccctccacttgcttgcatcttgcacagaactgtaaaaaggtcctttaaatgctcagacagcttccaactatctccaaaagtgaaagtacttacccatgattgtaaatatccctgtcccactctcaaactgtccgctccccatagaccaactggagctctttaaataagtcagacaaatatattcctcattcctcaaaggactcaccctccctttcacattccggttgtgcagattaaacatactccacaccatcaaaccaagttatttttcctcgagaactctcttagaggttcctttttctctaacagcctgcccacctctgattcctgggattttcgtgttgacgggatcgttgggatctttcctctcttctcatctttccagtaacccattagcattagcaggattattggacaggcctccgtttgcattaatatctccaatgattctgtgatctccgccctaaagacctttgatttcttttggtcgcgcctccccttcgggacaccaagtttgtttagggcctgagcacaggggcccagcaggttctttccgacgtcagcggctgcgtacggaggccgacttaggcaggccgctccaggaacaaggccgtgcggacaggactgacctaggcgcttttccccgtcgctcccagaggagaaacgtaccggggaggggacagaccgtgagcaagtggtccaagtctgcgcagggtgaccccgaaggcccaccggagaggccgaggcttgtgggctactagaactaggcctggtaggtgaaggaggcgggtgaagggccggatccaggactgaatccgggagaggcggggcgaggaggggactccggtgtagctgcttgggcagctcccgcggcccctctggcgggggtgaccgttattggactcgcagagggaagagttgggtagcgtcccctactcacctagaagcgctgccgcctgaggctccagctgcccccctcccaattcaagccacgtcagctcgggaagcccgtacgcgacaccttccaccgccgcgccccgccagggactcagccactagcagttgggacggaagat

SEQ ID NO: 1733 - DNA, 86569 bp, Homo sapiens; identical to SEQ ID NO: 1732
  source 1..86569: mol_type = genomic DNA

SEQ ID NO: 1734 - DNA, 86569 bp, Homo sapiens; identical to SEQ ID NO: 1732
  source 1..86569: mol_type = genomic DNA

SEQ ID NO: 1735 - DNA, 86569 bp, Homo sapiens; identical to SEQ ID NO: 1732
  source 1..86569: mol_type = genomic DNA

SEQ ID NO: 1736 - DNA, 22645 bp, Homo sapiens
  source 1..22645: mol_type = genomic DNA
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtaagtgaggcgccaggagcccagagcgctggggcctccggatttaaatcgtctggggagagcggggcgttgggaggggtgggatagaagaggagagaaatcctggtaatggaatacagttggctatgagaaaaaaattccctaggaaacagttcctctagtttaacaactcagatttttttttttttttttcccctttgcgggtttcctaggctaagatagaggcagagagcaaagagataatcagggtaatagtttctgctcggacacattctacaaactttgagtagatggaatccggccaggcaggaggtgagcagctctgggatcactctgcaggaaaagaatagagggagaaagatctcagaggacccgaaggtactgggagtggagggggagtgggaaacaaggggcaggggcaggagggaggacacggtgacagctactattttacccagatgctgcaaaaagcccttctgagttttgggaattagatctagaagcccatcccttttctcttgatgtgtgggcggtcagttccactctggtgtgccttgagttgctcagaaacctgggacagatgaaagttgaatgtgcgctgagagtgcaccttccactaccgactttatggataggatttgggaatagcatagatgctgttccatctggtcccttaaacatccatggggaaggctggcaaatagctttattttattttttgagatggagtttcactcttgttgcccaggctggagtacaatgttgcgatctcagctcaccgcgacctccacctcccgggttcaagcgattctcctgcctcagactcccgagtagctgggattacaggcatgcaccaccactcctggttaattttgtatttttagtagagacggggtttccccatgttggtcaggttggtctcaaactcccgacctaaggtgatctgcccgcctcagcctcccaaagtgctgggattacaggtgtgagcccccgcgcccggccacagatagctttaaacatccatgggaaaggctagctaacagctgaaacctgctcagaatcaaggaatttgaaggactttccattcctgacttctttccattcctgattgtctcctcagaggcttgtgtaaacaccacacctgttgaagggttcggccgaatcagccactgctgtgggttcattcctgaaggggaacacttcagctacttcagacacaatgggctagggaccacgggaggggtgagggcggagggggcacacaccctccaggtttgcatgccggtgtctgctaggtgagggaaggaatgaggggaaggaagggccgggagaggcgctacgtgggaaacaagggacctctccaagggcgtggagaggtgagtgcctcaagggcagaatggaatgagcagaaccctttggtttcccgggaagagctctcaaccttgagtcaggaagactgatttctcctcccagctccgcaggaacatggaactgtgatcaggcaaggggctgggcctgagttcctcataggggtcttggggaggcccccagtttcccctcctgtgtttcgattctggcccctctccatctgcacacgtcgccttggaagttccctttagaactggcttttttgtattctagtcttgaatggtaatcgaagacaacagggtatgaagaacaattttgacggcgtgattttattcttctcattctgggtccactactatttaaagtcccaagattaagctgaggaattaatatggtggtatagtaaacaataaattgaggagtatttttgcttgaggaatctttgacttcctgagtagttcagggtgtttgcttcttttattctcatttttattgcactgtggtcagactatatggtctgcacatttcttattttctaattccagatttgtctttgtattctaaatatgctcatttttggcaaatgttccatttggaccatggaccatagttcctattaagcaatcataatagagtagagatggcaaactatggtccatggaccaaatatggcctatagcctctttctgtaaataaagtgatttttgttttgttttgttttgtttttgttttcgtttttttgagatggagtctcgctcttgcccaggctggagcgcagtgacgtgatctcggctcactgaaacctctgcctcccggtttcaaggtttcaagccattctcctgcctcaggctcccaagtagctgggattacaggcgcccgctaccacgcctgggtaatttttgtatttttagtagagacagggtttcaccatgttggccagactggtctcaaactcctgacctcaggtgatctgcctgcctcggcctcccaaagtgctgggatcataggcatgagccacaacctgtaatccactattttactaaaacacagcaatgctcatatgtttatgtatcatctatgctgctttcatgctacaaatgtgtggcttgcagagtcttaaattgcttataacctggccctttatagaaaatctatgctgatcactgatatagaggatctgaattatatgattagtaatggagatctaataagatatgaagatagagaatatttctatttaagtatccatagaacatttacacaattttaccatgttcttattcatattgtatattttatctgccaaggactggtaaagaagtatgaaagtctcatgcaactatagtattgcctttgggttctccttgtattttcagcagttatttatttattttgagacagggtcttgctctgttgccctggctggagtgcagtggcacaatcttggctgactgtaacctccacctcccaagctcaagtgatcctcttgcctcagactcttgagtagctgggtctacaggcacccaccactacacctggctaatttttaaattttttgtagagatggggttttgccatgtagcctaggcttgactcaaactcctgggctcaagcaatcttcctgccttcacttcccaaagtgctgggattataggtgtaagcctctgtacccagccttcagtactttttgttttacgtattttggtgctatattagttggtgcataaaagtctaggatggttttttttttttttttttttttttgagacagagtctcgctctgtcacccaggctggggtgcagtggtgcgatcacggctcactgcaagctctgcctcccgggttcacgccattctcctgcctcagcctcttgagtagctgggactacaggtgcccgccaccatgcccggctaattttttgtatttttagcagagacagggtttcaccgtgttagccaggatggtcttgatctcctgacctcgtgatctgcccgcctcagcctcccaaagtgctgggattacaggcgtgagccaccgtgcccggcccaggatggttttatcttcagtgtagagcatccctaattattataaaacaagccttttggtcaatataatatctttttgctttgattacaactttgtatgatattaaaaccttaacttctacttaattattttaccttgaacaacttacttaactttgtgtctgacacataatacttgttaaataaatattatgttagtatttctttttattttcatttctttctgttcttttgcttttaactcttgtgtatctttttgttttaggttaggttcttctaggtatgatatagtttagtctttttttttttcaaaatagttaccatttacatttcttgtaataatagttacttgttattgtcatctaattttaggctatatggtttggttgtctccatctccttctgcattagacagtatatatcatatcatatttttagatctactagcaactgagtagatggtagtgccattctcagggctttgaaagataggcttgtaaggagaggtgatcagtttagctttgaacttgttggatccagtgaatattacccttatgtatcagaataagatatttaaatgaagggatctttgagagccttaagatagtatactagtagagggccggcgcggtggctcacacctgtaatcccagcactttgggaggctgaggcgggcagatcacgaggtcaggagttcaagaccatcctgactaacacagtgaaactctgtctctactaaaaatacaaaaaaaaaaaaaaaaaaaaaattagccgggcgtggtggtgggtgcctgtagtcccagctactcgggaggctgaggcaggagaatggtgtgaacccaggaggtggagcttgcagtgagccgagatcacgccactgcactccagcctgggcaacatagtgagactctgtctcacaaaaaaaaaaaaaaaaaaaaaggatagtatactagtagaggacttcactttattttcctattttctggaaatttcatttctttgaattcgggcataagagatttagaagcttcactcaaatattaagctttatttaaaaagatgatttccagtatttcattttatattcacattaatcaagtctacatgtttcgtttagagtaacaggaagatggtaatacgcccagggaactatctggaagtgtagaaattgggatgaacaccgtggttatacttgttttgatctgcctgtggtgctatgatgacttattttctctcattattgcatagaaactcaattcagtgatgttattcagatgttattcataagttattgccatgattcatcacttttatgtcatcagagttgggatggctacccagaataggggatcctggagatttccctgtagacgctttgcatttataaataatcctttatcaagggcagagggatttctgtaggacttctcccttagaagaactcagcctgggtagaaatacgaggattaacatcagcacatattcatctccaaaaaattttcctccccattactcacacttgccaataaataacttgctttgggtaaatattcagcactcagtcttagtccaaagcatttgctcagcaatcactgtgtagagtacagagtaagggggataccaacaaatagaagtttgctctattttcttaagaagcttgttgtctggccaggcacggtgcctcacgccaccttcctatcttcctaggagatagatgccacaaagaagcttgttgtctgataggcagctcagcagtgatattaatttgtaatatataacaaagatatggaaaaacttgagtgccaagaaatatttaattgtaaaaaccatgaagagatcgacacatttagagtgcaataggatttcaagtccaggtgtgatggcttacgcctgtaatcctagcactgtgagaggctgaggtaggtggatcacttgagcccaggagttcgagaccagcttggccaacatagcaaaaccctgcgtctactaaaaatataataattagctggatgtggtggcgcatgcttgtaatccaagctacttaggaggctgaggcacaagaatcgctttaacctgagaggcagaggctgcagtgagctgagatcatgccactgtactcccaggctggagtacagagcaagaccctgtcttaaaaaaaaaaaaaaaaaaaaggccataggattaatagtaataatgataataatttaaaaaactcatgatagaggttaaatcttgggcaaagttttgcagaaatatggtaagtggatcataaataggagggagaggatctttctggttaggagaataattcatgtgttgaggcaaagagcatgagaagaccttaaatgaacccaaattcccttccagatggaaaatacagaactctaggaagatttgcttgccttgcacggaggtggagacgggagttagggaggaaggaggagataggtgggaggactaattggagaaaggccttgaagctcaaactggggctggatctgccgtgacagacaaaaaggagcgaatacgcttctttttttttttttttttgagaccatgtctcactctgttgcctaggctggagtgtagtggcgtgatctcagctcattgcagcctctgcctcctgggttcaagcggtttttgtgcctcagccttctgagtagctgggactacaggcgtgagccaccatgcctggttcatttttgtatttgtagtagagatggagtttcaccatgctggccaggctggtctcttaacgcctgacctcaggtgatctacccgcctcggcctcccaaagttctgggctcacaggtgtgagccactgcgcccggccgataatttctttttaacctcctttgcggactcctacctagatgagatggtgctccacatggttctgtccttggcttcccatgtgatcttgtctcctcttgaggcttcagataccactctaggtgatgactgccagtctgtgcttacagcccaaacctctcctgagcaccaacccatatgcccacggtgcagagacagcacaacccagtgtcaaggagcctggcttttaagagtcatgtaatcttgggcaagttatgtaatttctctgtgcctcagtttcctcagctgttaaaggaaggcataataatagggttgttgtgaggattaaataacaccatatatggccaggagcagtggcttgtgcctgtaatcccagtactttgggaggccgaggcgggcagatcacctgagcctcaggagttgaagagctgcctgggcaacatagcgagaccccacctctacaaaaaatacaaaaagtagctagatgtggtggtgcgcacctgtcccagctattcaggaggctgaggtaggaggatcacctgagcccaggaagtcgaagctgccgtgagctgtgattgtgccattgcatcactccagcctgggcgacagagagactttgtctcaaaagaaaaaaaaaaagaaaaaagaaaggaaaccatatatggctcagaggaaactctcaagaggacttgggtcttttgacttgttattcctggatagctccacgtgcaggtcgcatatttatcaaagagccaacaaagctacacttagcatctctcctttcaagcctgtatttctaggctctgacagtggtgccactcagttgcctaagccagaaatctgggagttaacctgggcttttccattcccaaagccctgtctcttctaccttcataaaaatctcctaccatttcctgttcatctttcatgtttcatctccctgctttcttccctaaagcattaaacattaaaaataattattttaaaaccccactaggtagaatgggtcactgttttccatgtgccctcagcattcctaatgtattccataacttcttagttgtatgtcagtgtgattattattcattccaagggcagtggccacaattttatatttatttatttagttttttgttttgagacagggtctcactctgttgcccaggctggagtgcaatggcatgatcatagttcactgcagcctcgagttcctgggctcaagcaatcctcttgcttcaccctccgagtagggggatcacaggtgtgatcctggctaaattagcacccggctaatttttaatttctttttgtacagcgggggtctcactatgctgcccaggttggtctcaaactcctgggctcgagtggtcctcccatctctcggcctctcaaagtactgggattacaggcgtaagctactgcccccggccagggttgcttgttttggagacttctcagcaagccaatgcttgaatatatggtggtttaaatggagagaggttggggtcagggagaaaagctctagagatgatgacagtgatttagaggtgaaaaggaggattgaattatgattatgactacttataaagagctattctttctgaccatgtgacactggacatgtaccttcctcactctgttaggtttctcacctataaaatgggctgtaggaatgttaaatgaggtaatggatgtaaaagcatgtaaatgagagaatatgtgtaaaaatacataactactcagcatagtgcctgactcataataggactcaggaggtgacagtagctgtcattattcttactcataattacatcatgactgttattactactgactgaatgtagcaattcgagaatagagaaaaaatgaaaatgctagaaagtcacacattttcagggctgggctggcgcgaagacacattttgacagaatgagagaaatctcataggaaggaagacaaagtcagtttgtctttgcaaggttctgggccccagatgattcattctcagatgctctgggaaggactgcgtagaataagcatgggcaaacttccaggcctagtcacaagcaactctacacactttccccatctctctggttgcgaagaggagtctcaggttagaaacccaaagcgggagactcatcacatgttcacgtttttccctgcacagtggtcagtgctgtgtgtcagtcaaggccatgtctagggtcagcgctgctccaggagcctctggctttgtccttcaggtgggcagtcccttgctgtgtctcttcttcagacccttcaaccttacctctagccctggcttttagtttgggtaggagtttgtggcacatactcttttaatgacaggagatggggcaagaatgaggatgagggggagaaagaaagacatctggaagttttgtacatgaagctccccaggtgggtgaacggtggagctgaacatgagttcagaccacgtagttcagcagcgtgtcctgcattttatagatgagaggaggctttgagaggtcaagtgacttacttgttcacacagcctggcagctgaaaccccttctccctaaaggggaggaggaacagagggcttggagttgacccaagaaatgacttcgccctcctcttcctttcctccctcttcctcttgttcttattcttcccttccctctccctcttccccactggtttttctaaacctttcttttggggccgggcacagtggctcacgcctgtaatcccagcactttgggaggccgaggcgggcctgaggtcgggaggtcgagaccagcctgaccaacatggagaaaccccatctctactaaaaatacaaaattagccgggtgtggtggcacatgcctgtaatcccagccactcgggaggctgaggcaggagaatcacttgaacctgggagatggtggttgcagtgagctgagatcatgccattgcactccagcctgggcaacaagagtaaaaactccgtctcaaaaaaaaaaaaaaaaaaaaaacaaaaaaaaaacaacccagaaaaacccaaaaaacaaacaaacaaaagaaccaaaaacccctttctttcatgcctagattcattccaaaaaggtttaagacagcaacaagtgattccaggatctcagctgtgggcatccttgtgttactggatggctgtgtgttaattgttagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccacctgcggccactaagataggagcggggttcagacatggccaggcgctcctaatctcagacccaaagtgcaatttttggcagcctgcatgagaaggagggtgggaggaaaggtggctagaaccaagggtagcagcctgggggcttgagaggaaaccaggcacagcccatcctaccctgtctcacgagcagcccgtcctcctcctgactccccttaccccacacaccgagcgccattctcttgctgcctcatctattctggttaggtacttactgagcatcaggtgctaggcaagtggctggggagagacaacgtttaatgactcagtctccgcctgcacagagcctttgagtctagagggagacacagacttactgacaggctgggttgtgtaataagtgctacgggaggaaaagctgagagtgtctgagaatttatgagatgtgtgtctcatcagacttgggcatcaaaaaaaaaaaaaaaaaaaaaccatcctggaggaaaggacctctacgtcaagtgaagggtggggtccatttggtttttataggagcaagttctttgttggctggactctagatctcccgtcctttgactttggttacaaataatatccaaaccaccgctagtctcattctcttttctctttcctgctctagccctttgctcctctcccaggctgtttctctagctccagacagttcatattcctaaatgctgatcacttctcttttccctctcaaatgctgctttctagaaatcattttcagtttttcagaaccctgtccatctcttccaatcccctggtgtctttcccttacctgggtcattctctgggcaacatggcaccctttcagtgcagacttgtttattaataactccagtgagttttattttcctcttactaaattcaaagtactcagaacattttagacttgttgagcaatccctatcagcttagggatggggtgggggaggctaacagaggtgaattaagaatgataattccaaactaattagtcatccagattaaaaaaaatagactaagatggttttttttttttaaagacatttgtgagagaattgggaaatatgaatcctaactagatagttgataataaaggattcttgttagttattaaagtgtggttaagaaggagtttttatcttttagagagacgttctagactggacatgggggctcacacctgtaatcccagcactttgggaggccgagagggggaggatcctttgaagccaggagttcaagaccagcctggggaacatagcaagactccatctctaaaaaaataaagattaaaaaaattagccaggtgtggtggcatgcgcttgtagtttcagcttcttgtgggtgctgaggtgggaagataccttgagcccaggaagtcaaggctccagtgagccacagtcacaccactgcactccaccctgggtgacagagtgagaatctatctcaaaaagaaaaaaaagggctgggcacggtggctcacgcctgtaatcccagcactttgggatgctgaggtgggtggatcagctgaggtcgggtatttgagaccagcctgatcaacatggagaaaccctgtctctactaaaaatacaaaattagccgggcatggtggcgcatgcctgtaatcccagctactcgggaggctgaggtaggagaaccgcttgaacctgggaggtggaggttgccgggcgccgatatcgcgccattgcactccagcctgggcaacgggagtgaaactccgtctcaaacaaaaaagaaaaaagaaaaaaaaatacacatactatttatagataaaattacatgatgtctgagacttgcttaaaaatagtctagggagtggggtggggaatgcagacgaagcaaaattggccatatagtaataattttttgaaatgaagtgctggatacatgggactccattataaaactttctataatgaaaacaagtttttttttaatttttaattttttaaaaatagacacggtcttattctatctcccaggcagaattgcggtgacgtgatcacagctcactgcagcttcgaaatcctgggctcaagcaattctcctatctaagtctctcgagtagctgggactacaagtgtgcccctccgcacctggctaatttttacatttttatttttctagagacagtggtctcaccatcttgcccagactgctcttgaattcctgggctcaaacgatcagcccgcttcggcctcccaaagtgctaggattaaaggcctgagccactgcggctggcctaaataatgtttaaaaggaacttcaagaactatttctccattccctgttgcatgattgggaggtgggaggtggaggtgacatttggggaaactggttttttcttctctttacacccactgccattacttttgttggatcctggtctgtgggttctataaggccctgagactcagcaccctcctgcgcagctgcgctggaagaggagcctataggttctagatgggggctctgccttccctcctgtctgtccagtaccagaactgttcttgaggcaaacaccacatcaatctctgtcaagatttagagtcatcaggttcaaagtccctcataacgatcctgtccctcataacaatcaggtaattatgaaaacaactacttgtccacaaacagtaatacctgatgggtggggaaggagcaattggcagagaggggcagggagagggagagatcaaagggaagagggaaatacctttcctgctagacaacaccctggtgattaatctgccggggtgtggagagacacagtgaagtgcacagggcctgagttccttccgctcgccgcccttgaaggaaatagggtcttcctcttccacattcacggtgtagcctgggagagccctcatacttcctctttcttatgtcaaagaggggaccaaagaggggacatttgtaggcaagacggatcagacttgggtgcttggattgcaggggctgtctatatctgaacctcatttgcctttttcttcctatttctcattctgcactgccctgtagaggtatagcccattctttgtgctctgcttgtggtagcgatggctgtggtgtagcttccaggagggtagagtgtttaggtgacagacccactgtgagggaaggcggtgggaggcccatggccatagtgacaggtgccatccgtctctctcttctactgtggtagaagtggaaacgtgtctgtttctggctttaccatggagtgcttagagcagtgatcagcacatagtggtgctcggtaaatatttgttgaatgaatgactacataaaataaagttgagattggagagccaaattttattaaaattcgggaagatcgatttaagctatatctggtgtcactttaacacactatacataatatcgtgataatatatattcacatgatattcacatatgtatcatacatatgtatgtatatgtatatattgcatatatacatatgtacaatcttcctacttgctatatgaattaaataattttggtaagatgactatctcttctagtggaaaagaaaattttgtggtttttttttttttttttttgagatggaatctctctctgtcacccagcctggagtgcagtggcatgatccccgctcactgcacctctgcctcccgggttcaagcaattcttctgcctcagcctcccgagtagctgggattacaggtgcgtgccactatgcctggctaatttttgtatttttagtagagacagggtttcgccatgttggccaggctggtctcaaactcctgacctcaggtgatctgcccgccttggcctcccaaagtgctggaatggcataagccactgtgcccggccaagaaggttgttttttccgagctgttttttctgctctaaggaaagaggcaggattcaggggatgctttgtatcttttcctgcttcccaacccgagtccttcctcttgttttggatttcttgctgcatcatctctgtccttctttagggctggaggtgacctctgcgagccttcccttcctctaactctggcctctttcctgctgcaacatagttctcttctagtccgttcaaaactttttattgccacgtgaacaatctcattgggaaacaaaaaactcaagaaaaaaaatcccatgcccaaaaagcatggaacacaacaaaaagaatagtgtagaagacacttaaataagcaataaaataatttgaatgaaattgttgacaaactggactatagttatgtctagccttgttgaatctcaacatcttattcgacattgactttggaatttgtgagccacctgttttgaggaaatggggacactcctttctctttttcgatttcccaatttatcttcccacttgtgccctgaatcctgaggacttagatttcctaggggtatggtcaaggagctgggtctaaaattcacacgaagattgtaggggcagagaaagaagcctttctcctgacaaaggacagatatatgggaagtaaactgtaatacagctagtggcttcctgattatccgaatgagtaagtagatttctcactttgtggatggtccgttacctgggatctcctatcctcctggggctgaactaggagagtggaaccagagtcataatgaggcatctgatgaggggaggggtagggagagagagaaagagacgtagagaggaggagagagagaaggatatctcagatctcattttaaggctaatttgagaggagacacgtagagtacttgagaacctgggtcctggcaccagacaacctggattcagatcctggctgtgccatttcctggttgtatgatgttgggcatgtaacttgacttctctgcctcagtttcctcatctgtaaaataggataatagttttacctcatagggttgctatgaaatgaagtaagtaatgtatatatagagtgattagaagtaaaaattcgaggctgggcggggtgactcaacacctataatcccagcactttgggagggcaaggcaagaggattaattgagcccaggaatttgcgaccagcctgggcaacatggtgaaaccccatctctacaaaaatacaaaaattagcggggtgtggtggcacacgcctgtaatcccagctactcaggaggctgaggtcgggggaggatggcttgagcccaggaggtggaggttgcagtgggtcgagatccagcctgggtgacagagcgaggctctgttccccccatccccccaaaaaggagtaaaaattggagcaatactaaaaatgaacatgttagctatgaagattattttttgttggattacccgctatttatgtgccatccaggacgttcctctttacaggtagccaatttagagctggttatgacagacaagacccctttcataacttttcggaattagtggagccatctttacacatcttaaggaggaggccgggcacggtggctcacacctgtaatcccagcactttgggaggctgaaggagtttgagatcaacctgaggtcgggagtttgagaccagcttgaccaacatgcagaaaccccatctctactaaaaatacaaaattagctgggcatgttggcgcgtgcctgtaatctcagctactcaggaggctgaggcagaattgcttgaacccaggaggcggaggttgcggtgagccaagattgtgccattgcactccagcctgggcaaaaagagcgaaactccgtctaaaaaaaaaaaaacaaaaactcaaaaacaaatcttaaggaggaggggcagaataattctgaaccacagagcctaagaagaggacccagccgctggctcagaagggaatgctcggccttctgtagaaaaatctgctattcagagaccatcatgggtaacacggtgaaaccccgtctctactaaaaatacaaaaaaaaaattagccgggcatggtggcacatgcctgtagtaccagctactctggaggctgaggcaggagaatcacttgagcccgggaggcggagcttgcagtgagccgagatcgtgccactgcactccagcctgggcgacagagcgagactctgtctcaaaaaaaaaaaaaaagagagagaaagaaaaatctaccattcagataactcctcttatccatgagagaataggatgcttacaaatgataactgtatcagggccaaaggtagaggctgcaacgttatgattaaagtgttaacttcaagtttagatagttccatgttcactaattcctaagaaaacactagtaaaaaaatatcaggaaccctggcaggttatttgtaatatatacacgtatatatatttcaagagacagggtcttgctctgttgcccaggctggggtgcagtgacgtgatcatagctcactgcatccttgaactcctggactccagcgatattcccacctcagccttttgagtagctgggactacaggtgcgtgccaccatgcccagctaattttttaatataaagatggagtcttgctatgttgccctgtctggtctcaaacttcagagagcaaatgatcctcctgcttcagactcctgaagtgctgggattataggcatgagccaacacgtccagccctgtgaagttttttgagattaggcttcaaaatacctcttcagagtgttaggttctctggctttaaggtaaatattaatatagttaaactgggggaagggacatatgggatttcttcctggttcttcaacaggttttagaatttactacaggaggtagaggaaagttagtagctttacttaatgtagtaagctcaaagtcaaaaccctggctaaacatgcaaaattggtttcctaatccttttttagtcttctgtgtctgaggactgtgttaggagattcaataccttctccccactccaacattccttttctgcaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaaaaaaaaaagaatcaagtgattttgctcttatctggagttgagacaagccagatgttctcgtgttgttttcataagcaaaagaggctaaactgatggccagaaagtactcctgctcatagggacctattcattggtctccagggtttacactgacctttaagtctaatcacagggggtgggtggttttgggataggaatgaggaacctccaaggccatgttcttagctccagctaaaaataggtctttcctttgctcttaagcctgaggtgtggaacttcctggtgctactcactgcagctatggtccctgtctagggcacttggaagtctgaagggaggcggaggagggcaggaggggttatttaaccacccagcccctcctgtccgttccgtggcttcactccatcacctcactcctgtacttcctgttctcattcactgatgagtcttccttccttcattcatttcaagggccactgtcagctttctcccttaaaatgcttctctggcctccatgctttgctgctcactttcctccctgggtcccctgagccaccccatcccatcaaatccttcctgagcccttccacagttggaaccaacaacctctgaagctttgctcgcagtccagatgaaccaagtcgctgtgctttcctgcctgtgcctgtgctccaggtgtgtctgtcctctgcctggtgtgaccatctccctcttctgcccttctccaggatcaggcattccccagtttcccctggtaatcactccaccctgtgcatctgtaggactttgaaatgctcttatcagggtctgtctcattgcactgttatttatgtacctgtcatatgttccttactctccagtgtcagctgcaaggagggatcattctggttaatctttatgtgcttcaccatctctctcttttttttttttttttgagacagagtctcgctctgtcacccaggctggagtgcagggacataatcttggctcgccacaagctctgcctcccaggttcaagcaattctcctgcctcagcctcccgagtagctgggattacagacgtgcaccattatgcccaactaatttttttgtgtttttagtagagacggggtttcaccatcttggccaggctggtctcgaactcctgacctcatgatccgcccgcctaggccttccaaagtgctgggattacaggcatgagccaccgtgcccagccacgatctcttaaataaaggcgtttaagtgtttgttcagcaaattgggcccataaatttggtgggaaataaatgaattgctttgaactgcattcatgatgattgcatgtgtttatccttgtttcccaagcctttggttttccccaaatacacagaaaacagttgctcatcaatcctgcctcttcccaatgaaaatgatacaaatatatacatattttccttgtcaggcagttgaaataggtaaatccccagtgagattcactctaggtacacccctggccagatctatatctgaaatgactggtttttatgactttttcttttttttttttttgtttgagacagagtcttgttctgtcgcccaggctggagtgcagtggtgcgatctcggctcactgcaagctccacctcctgggttcacaccattctcctgcctcagcctcccgagtagctgggactacaggtgcccgccaccacgcctggctaattttttgtatttttaatagagatggggtttcaccttgttagccaggatggtctcgatctcctgaccttgtgatctgcccacctcggccgcccaaagttctgggattacaggcgtgagccaccatgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaa

SEQ ID NO: 1737 - DNA, 70299 bp, Homo sapiens
  source 1..70299: mol_type = genomic DNA
acagactgcagggctgactagggttagtttggaggagggagtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaaggtatgtcattatacaacatctgtacatatactctagaaactttgaacagttttataatttgcagaatgttctgtatgagttaattaaaatgaatctcactagttctctaaatattgcttttaagtcccatcagctaaggtctctaaaccttttgctgtgacaatgtttgtggtgatgggatttgacttctatcaaatgaactgggagaacacttgttccttacccagtccataacacaaaaatctccacaaactggcttcagaagcatctcagggaaagattttcgaccttgggatcatggaggtaaaattccacttcaccatggtcagaatttaatccaaattggaagggattggagggggtggtagagggctgagcagtgatgaatgaacactagcactctgaggtcaggatttctctctttgcttgaatttctagttctgttcgcatttttgttacctgtacaaaggacaccagttttcattcctttacgaaaagaaaactttatgttgaagtgtattttggaagggtattgtctctcttcgtactagccgttaggctccatccctatgactgtctctggtttaggcgtccagtctgaagatagctgctttgtgttctttgtcccaactcttcctgaacgtgaggattgaacataccaaccaaaggtttcactaatttaaaatgtactgtattgccctgacaggtatactgtcaaaaaaaatttaccgtatttatctacctggaattaggccttcttaataaagtgtatgcagcataatttgcacactattgaacatacacatccctagataaactaggagtgggaagtgttttagatctaaacatccaatgggaaaaatttcgtgtgttctcgttatgttatctgaggatgggaaacttcaggtcgcagaatcttttgttctatgcagcaatgtttgtcataaacggtttagttctttagtggctcctttttgtttcttatttttggtttcggaaagagtatttagcagaagttactctcctttaacaatccagtattttatgtaaaactttatagaataattttatagtgattctctttacaaaaccatctgctattaaataaggaacactgtgtaaatagaggaccacctaagtatatttaattttcaaatacgaaaaaaatctgactcatacccttttttgtttttttgtaaaagagaggtggccctatattattgaataaaactgcttttttagattgaacttggagtgtctcccatgtggtaaactgaaatcttattctccccaaattgtaatagattttatctttttaaaaatgactttactgaagcagaggagaaggagatgatcaatctattcaatatgaagaaatatctctgttgctaatacaatatccttttgaatatctcccacatcttaggccctggtgaaaatccctttcaattgttctgtctacctcgtagggatgttgtaagaataaatgagttaacatagatatgaagtgccttaggaaaaaggctctataaaaatgcaaggcgatatcatgattagttgtttctttgactcttgatcattttcttcccacttcttatacaaaatgtctctcacttatttcctgaagccatctcttttagaactattgcttcctagaagagctgaaaatgatcctagttccaacatatttattgattcccagataataacacccactggtgttgatgactgacagggttcatgcctaagcttgagtagaacttgcccttttttcctgggtcaagaaaagtctgcaattgttcgaaaatgtgtcagtaagtgtgattccatcacgatttcttaaataagtaacagttgctgctggataatcctgggggcagatgattcatttttgtgcccctatcaaacaaactcaaaacttgttaaagaatctttataagttgtttgaatcaaacaatagggtcgctaggtccccattttgtccatttgaggtatttgcccagcataccttggtctgtaaagaaatagcacagccttggctgggcgcggtggctcatgcttataatcctagcactttgggaggccgaggtgggcagatctccaaaaataaataataataatgataataacacagcctcatgagtcttttttttttttttttttttgagacagggtctcactctgtcactcaggctggagtacagtggcacaatcacagctcactgcagcctcaactaccctgggtttagtgatcctcccacctcagcctctcaagtagctgagactacaggtacacaccaccacacctggctaatattgtatttttagtagagacagggttttgccatgtttcccaggctggtcttgaactcctgaactcaagcgattcgcctgcctcagcctcccaaagtgttgggattacaggtgtgaaccactacacctggcctgccctttcttttctcttaaaaattcttaagaaagcatggtcctgtttaacaaataagcattttacaaacatttatcgatcaattactatatgccaggcctggcactaggcaccaagtcctcttcaacagtgttaacattaagtttcaataaacttgagtcagtaggaattcagtaaataatttttaaagattgttttctttttaaatatgtatttataaacaaaaattttagagaattaaaagaaactatcacgaagtgcatgatgataaaagtcttatatactctccaaagaaaatgttaagacataccttaaggagatagtgaagaacagccgggcacagtggctcacacctgtaatcccagcacttgggcggccaaagcaggcagatcatctgaggtcaggagttggagacaagcctggccaacatgttgaaaccctgtctctaccaaaatacaaaaattagccgggcatgatggcaggcgcctgtaatcccagctacttgggagactgaggcacgagaattgcttgaacccgggaggcagatgtttcagcgagctgagatcgtgccactgcactccagcctggtcgacagagcaagatcctgtctcaaaaagaggaaaaaagaaaagaaaagaaaagatagtgagaaaataactgaacataaaacataaagaaaagttgaaatattagtactcactacctaggttcaacaattgctaactctttgccgtatttgctccatctatacctatttctttctgaattacttgtaagttgcagataaaataatacttcactcctaaataattcagtactcatctaagaataaaggcattcctctatctaaccacaattccatcattaggcctaagaggataaacagtaagtccttaatatcatctgatagctagtgcagatttaaccttccccatttgtcccccaaatgtcttctataccattttttaaaaaaagaatctaatttttaaaaataagaacatattttgcagttgggtctcatgcttctttcttcaacattggatgtttttaaagattacgccagttctcttgtaccaggtcccactttctgaattcgttgttgcctcatggttaatttgttcctctacccactttatttctcataagctccaagttaggactaaaagcatgatttgattttgattgaacgttttttgcaaggtgccactgggtgctccatattgcatcttatcaggaggtacagaatgccaggttgttccactgtgcatgatgccaagtttgatcagggcttgaggtagtgatcttgctcagaggatctcttgttgtacaggcactttttcaccctttgcaattagcgagtactctcagggggtatctcaaagtgtatctcataaacactttggcatggtggcaatatcctatttcccaacaaactctcacccggtgactttaggtaataatctttgcctaaattgattatttcattggagttcatatatatttttaatacgctttgaagatggactcgacatgcaaattcatcattatcagcagcaatagtggctggaaatatttattgagtgcataagttcaggtaataataataatagtaggtaatgtttattgagtgcttgctgtggagccaagacagcctcggtgtgagcccagtctttcacttactaagcgaatgaactgggacgagttattctttttgtgcttcagtttcttaagctataaaatgggattactaatggtgcctatctcgtgggattgttctgaagagtaaacgatttatacatttaaggttcctaaaacagtgcctgttattattgttatttgccaagcattgttctaatactttgtaggtactaactcgtctacttcttctaatggtgcaatgaagaaagtgctaataatacccttttttcacaatgaggaaactgaggtacggagaggtctagtacgttgcacaaggtcacttaactagtacctggtggagccaggatttgaacccaggctgtctggttcctgagcactctctctgatgatgggcacatgcagtgaggagtgatacaagtggagctgagtggaagtagccctcacacacactcagacttgaagttattgaaaatccgggaggttgccacccaaacacatttaaggtttaattcatctgaataagaacagcattccactaagcccagataagtactcttattacatttacatagcttaaggctctgtacaagaaaccttgaacataaaatacttggaacagaaaagagtaggagaactatgaagtaatggggggaaaaaatccctgaaaggaacaatacaagcggggagttatgagacctgggacctcagagcctcggggtggaagatgatattttgatataatcaggagggagaaatttcctctcatttttcacatttctgtactatataagattttaccataaaacgcaagagtataagccattgtcagatttataaaaggccatggtggatttccttaagagacgatggatgactgttgttagtaggtaaattccctggttggttatctcatacactcagatattccataagtcagcctgtggcttctgaaactgtattgagaaaaagctgtataaactaggtgttggtccatgctccttcattagcattacaaaagggttcgactgctgagttgaatcttatccactccttcagtggccattacagaaagctctcaagtgtaattttctaaagagaactaaaaataaataagaaaaaaaaaatccagcattaataatggttctttttgcatttccaacacagtcattgccaaattggttctgcctttttatgttttttaatgaaaagcagcctaattgatcaattggtcatgaataatacttcttcgtttgtttttctccacaccccccagccttctagaaccacgggcttaatgtgtcggcctacaaatggttcatgatttgtgttttttgtctagtgctttatgggaaaatattagaaacaaactgctgagaactcagtaggaactcagtaaataataagtagatagttctcttgttaaatatgattttaaagaaactctttctaaataactaggaaatattacaagggaagtacaaagtggggtggaaagcctggctgacttgtaatttgaaatttctcttcatcattttataggtcacacagtttaaccctttataaaacaaaatgtaaagtctgatagctgaaaaggctctcctccgctaaatagatttgtttgaaaatatagatcattaaatcggtaagaataacaggagaatctcaaccaaacattgagacaactaagaaaattgtctaaatctaataccttatatcagtactttaagttgaccataaatacgctgatatccatagcacataggttcttactggcagtggtggggtgggtgggggaaggggagtgtcacagacacattcaagatgtcaacgaaaactatgaaaactctccccaatggggaaaaaaaaccaacgatgcctagcacttatcctacgcaactttgtacagaatttccgtgggaaattctggtgtccatccatcataaatcacctggtgtccacccatatatcctgaataggaaaaattgtctttctctagagttattgtacactgatcctgatggagctttaaaaagagttgtcgtacaggctcattgactttgggaggacaaggtgggaggattgcttgagcgcaggagattgagaccagcctgggcaacatggtgaggccccatctctacaagatattcttttaaaaaattagccaggcccagtggcccgcacctgtagtccaagttactccagaggctgaggcaggaggatcccttgagcccaagagatcaaggctgcagtaagccgtgttcacaccgctacactccagcctgggcaacagagtgagatcctgtctcaaaaaataaataagtaaataaaaagagttgccattatcttgtttgatctggctatgatctttgaggtagacagaccacagattttacctctcattctgcagagtgggaaaagcaaggcttggagagtttccgggacttgctcaaggtaatttgctaatgtctgccgggacgtagcaccaagcctgtcacgctgtaggctgggccccttccacaacactggtccaaacacaggattctggagatgcaggagccctcgatgggcttctggaaagctgaattctggctctaccagagctacccacgtgatcttaaacaagtcacctaacttccctgagcttcagtttcttccttagtcaagtgagaggttagactgtgtgttctctgaagccctttgattttctgcagaaaaccacctaatcccactgggtctgggaacagagggaaatgaccttttctgccatagatggcaagacccttcacccttccctgtagggcataagagctggcatccaattcttaacggattcccttgcaatgtccaaatcccattagaaactacaaacatctcaatagtgcctttgtgggctgcttgggtgtcatgccgctggctgcctcacttgctgcagggctgactgtccacatcaattatactccaaccctgtgctctgcaatgggcagacatcccatgagattttattacccctcttgggtagttcagggagtcatatggaagtaaataatgctgatgggcttattttgggctgatagatccttatccttctaaagaggttatgcctttcaaagggtacaaaaccttctccttgattttttattacgaacagttatatcctttaatgtcccagaattgttcttggaagttggagactcacaagagggcctgcagctgtgaatgcagaagtcctgagactaggggaggacatcaccactctcccttggcctttggagtcatccaagctaagtgctaatatttgtgattaacaggtgttgataggaaattgggcccctgtgtctcagtctttttgtgcttcaaattttctaagtgaacttcaggctggcaagtggagttagatcaacttgttgcagacagtatcatctgctcggtaccgtgtcaggtcactggactgtgggaggttatactgaccagtgatgagagtgacagagcatgagcttggctcccgtatcctgtgttctgtgctcagcctcacagatgactcactgtgcctcatcgactcctctgtcctcgagtgaaattatgccattctttaacccactatacaagagacttttgaagattcatgtgtggctacccccaacaatatctcatttgtacaatgcagaacatggtgctttcttgtgtaaacaaactcattttgtggaatttttattttctagatcaatatttttaaatagactactaattcattttataaaccgggtactataagattttatgagttgacacttggtaccctgtaagtatccaaataatcaaagaaggagaaagtgtgaagtcaaggaatcccctagctgaaaagaaattcccaatacctggaacaaaaaagatggagcttttagagagcagactttttctccagcaaagatccacaacttccatttttaaatgtaagacgtaagggagatttatgatacagcctactttgtcagatcatattatttcataaagtgaagggtcaattaggtgttattattatcaagaaagcatgctgtaatgcttcgtcttgtagatgctgtaaaaattacctgtctgattactttaattcatcttttggctactgtctgcagaaattcactcagtccctagctcacaggtatgcagacgtactgagaacactttgggaaataaaagcaaaaaaaacattgggtcctttcccctaaggaatgaacagtgtatttgggaaactaggaaaaacaaacaaacaaaaaaatggtaccacaatgcaaaactgatgaggagattaaaaaacagctcaagatggagatttttagaaagaacttcttgaaggaggtgcatctgtaggctgagagagatggtttagcaagcaggcatcaatgcatccacaaagctttacacttcaaggaaatcataggagaaacagggtcttctttgctgaagatctgtttattttgcaaacaacaaagagtcagaagagccatgtgaagtttccatggggaatccagaaactaaacttctgccactggaaattacctcaagatcttttcccagatagcctgctcttcccctgcttccaatcatgtccctcaaagtcttctttttcaagcataaatatccttagttcttgtaaccactcctcctatgaggcagttttgcgtgctgccattattttaagcacccgcctctgattggactctagcttagggcctcccctaagtcacgggactcagaacggagcaacgctctccaggagtgatctgaggatgcagaacaccatggggtagttgcctcccttgatctgtagcctatacttctattaatatggcccatgattgcatgagcccttttggcacccatgtcacactgctgactcatatcgaaattgtggtcaactaaaacccatgagttcccatgcactactactaagccagatctttctttctttttcttttctttttttctttttttttgagaccaagtctcgctctgtcgcccaggctggagtgcagtggcgcaatctcggctcactgcaacctctgcctcgtgagttcaagtgattctcctgcctcagcctcccgagtagctgggattacaggcgcccgccaccacgcccggctaatttttgtatttttagtagagacggggtttcaccatgttggtcaggctggtcttgaactcctgacattgtgatccgcctgcctcggcctcgcaaagtgctgggattacaggcatgagccaccatgcccagccagatctttcttattctgtacttacactgttgatttaaaaaaaaaaaaaaaccctaggacagaggtttaaatgtaaagacatttatttctatttcactcgatcattttgataacaacttgtccaaatctttcagagctagggtattagcttcccctccctgcaggtgagtacttacctgctggtgcagctaatctcatgatggatctctggcctctaaagggccagaacttcattgtctctttcctatccataaattctctgcaaccgtggatgaatctgcatccttagacaaactagtgggcctcaatcttcctaagtaagataggaataagtgtgaatggccatttcctccttgcggtgaggatatgcgacaatgagttcgatgtctgcaaaaccctaaggaaatgtcactcagaggcagcattagatgaggagagaaaaagtttatttcaggctctcagcagctttcagaagacttgattatcctgatcactacgtgtgaaagttaatgacttcatttttgcagttattttaaaaatataactggtttatctgatttttggttgtagtaacatcacgtgatggtcagtatcattttacacattatttgtaatgtgagcaagtgccataaagcatatctgcaagactcatttaaaatgactctcttccctccatcacctcccccagccccatcctcaactctaccctcttctgtttgtaatacgggactacaaagatcttatagtttaggtttccgtcagacttttggaaacctttaaaagacttaccaagctagcttagaagttcatagattttcatccctggccagcgcagagagctcacaggtaacttgtataatatttatcatttcaagctcatagaaatgtcatatttcaaaacacatccctgagagcagtttttttgttccttatagacaggtgcagggaacatccaaatttttctagtctgccattctaatgcacattgtgatgttgctcttgtgaccctataattattaattttccagtagcccctccccaacctttcacgtgatttttaatccagggcctgggcactcgtagcagagtgtgatcctaggaccagcagcaacggcaccgccggggagcctgttagaagtgaggatctcagaccctgcctcaaacctattgaatcagaatctaaactgtgaaaaaattcccctggtgattcttatgcacagtaaaatctgagaagaacagatctagagtgaagggattttcactcccattttacccgctgtagaccttatgttgtaatacaaaacttacaaacttccatttggtgtttattaaaaggttagagtccttagttaaaatgttaccagattcaaatgttctgtttatatattcagctatttctcagtgtatgtaactggctttaaaatactcttgttgaccaggcatggtggctcacgcctgtaatcccaaccctttgggaggccagggtgggaggattgcttgagctcaggagtttgaggccagcctgggcaacatagcgagatcacatctctacaaaaaattaaaaattagccagggatggtgatgcatgcctgtagtcctagctacaggaggctgaggcaggaggatcacttgagcccaggagtttgaagttgtaatgagatatgactgagatactgtactccatccagcctgggtgacatagtgagaccttgtctctggaaaaaaagtactcttgcctttctgggttcttgtggagcaggggttctcccccactcccaccagggacatttggcaatgccaggaaacattttttgtcacagtttgcagggagaggtcctactggtgggtagaagctagggatgctgctgagaatcctacaatgcacaggatgggcccccacaacaaggacttaactggccccaaatgtcaatagtgacaaggttggaaaacaccagtatatgatttataaagactcagatgtgcgaccataaaccatagaatgccacaggaaaatagagtcacgtggcatgtcactatatgaccaggcaaagaacaaatagaccagcagtggccggagtgatggtggtggggttgtgagtggcagggaatggaaaatccagccacagatgaaaggagacatctaggaccaatgctaactggtactccgtgcacaaaggcagtgagctctagaggacagggctaaaaggccggtcacggtggctcacacctgtaatcccagcactttgggtgtccgaggcgggtggatcatctgaggtcaggagttcgagaccagcctggccaacatggtgaaaccccgtctctactaaaaatacaaaaattagctaggcatggtggcgggcgcctgtaatcccagctactcgggtggctgaggtgggagaatcgcttatacctaggagctggaggttgcagtgagcagagattgcaccactgcactacagcctgggtgacagagcaagactccatctcaaaaaaaaaaaaaaaaaaagaggacagggctgatgttcagggactggacaccaggtatgagccccaggaggggtggaaggaggtgtgggagaaatagagagagagaaggcttcagttctagagtggataccaggtatgatctcaaaatcgtgttagacatggaaaacaagaaaggatttcaagtattagcataggagtacacaggcagatttcaggtaaatccagtaagatgaagactcaggaacaaggcagaatcctgcttgctagaactggggcgcctcagagccaggccagcagcaggcatgaccgatgctgagtcagccaagtgttcaactagagtgagcttcttaaatccctcccaactgagaaggggcttagtgctgagtctacagcatggttgacttgcaagaaggggtcaagggctcccagctatggagaaaggtagaccagaagtaagccagaagtaggccagtgacagtggccactgaaaaatcacgggataagaaatggaacagaactcgagaggtcctctgggtcattcccctactgcagcgtgcacctaaatcatttcagaaagattatctacgcttcaactttaacattttcagagaaagatttcttaaagaccagtgggtgccttataatccatcgaagtcacagcttcttccccatttctaaccctaaacacctcttcctgggatgtaaagcgagtgtctttcatcccaccctgcacacagtgtgatttctatcattcagtaatgataaagaacacaaactgccgtctgcaactgccaagcacagccaccccttttccaggctaaagcatctcaattccattagtctgttgccctgagagtctctccctgaccttttaatcccctcattatcctctggacctgctccaagccttgcctgcttgaaatagttaccaccaagtatgtatttgttaaataaaagctgtgtgcagactgcccttttgccatggaacacaaaggaggaggaatataaaagaatatacacagttttgttggtttttattagtctctctcctctctctccaaggagttgtcaatcttctctgcacttatagtctagttggagcactagtccttaggctaaattccaccaaaacattttggttgttcagcaaacgctttcactgtgaccctcacctaagaacaatagagtacaccatcaaatgggatagctctaatgtgaatttagctctaaataaaactaggataaatgcatttgttcagttctagagaaggcatcatactgtcctgtggatttttcatttcgaatgagctgcaaaacaaagttcttttccatggaaaggatttactcaactgaattcactcactttgctgtagctggattaatctcatttcacatcatgtctctaagtagaaaagtaaactgatttacagcaggctaagtggatatgttgatgcatccaacatcagtgagatttattccaactagattgcaaccagaaaatggtgtcctggttgtttttgcttctataaagtagtcgcaaaagtgcaccactttcgtactcgatctgaaaaacagtttatcaaagttacaacagatgaggtattgtgggatgcgacagaacgtacgtacgtcaaatgaaatgagcatttctgccttcccagatcttgaaatggtcttttgccccacaaccttataaaaaaaaatattcattttaggccaggcacggtggctcacacctgtaatcccagcactctgggaggctgaggcaggtggatcactcgaagtctggagttgaagaccagcctggccaacatggtgaaaccccatctctactaaaaatacaaaaattagctggatgtggtggtgggtgcctgtaatcccagctactcaggaggccgaggtgggagaatcacttgaacccgggaggcagaggctgcagtgagccaagatcacaccactacactccagcctgggcgacagagtcagactccatctcaaaaaaaaaaaaaaaaagaaaagaaaaaaaagaaataaataaataaaatcattttattctatccccatgttctgaaagccacccttttttatttttgagttgtgtttcacggggcactgctcaaggtaaacacccagccccacttgtggttgagcaggcattgaccccacactggctccctgccctggagccagccaccaccctgttccttgctccaccttctgctttctgcagcacactctttcttctttttcttctgcatcactctgcatttccaaagccacaatcgtgtcatcctctcgggactctcagtctctgtctatgctggtgccctctcctttgtctctcccagattgctgactttattccagcttctgcttctaacacaataagactgctattggaaatgtttttctgacttctatagctggcagtttctataagcagaagttactttcaaaggaaagaacttgtggagatgagcctggggtgtcacagggctgttacatgggtcaaatgtaataacgtgtatcaaaaagcaatttgtaaactgtaacatgctcttcaaaagtaaattattactgtattatatgactttagggtttaaaaagcagctggatgatatgtaaaaattcaaggctcagtagcatcattggaaaagaaaattagaaaatggggaggggcacggacgcttccatcaacaagctaggggcctctcaacattttttccagccaaagcacacccatttagctgagagcatacactctcttctgaggactgcctgctcaccattctggacctaaggccttccctcttgcttaagctcccccatccctctcatcgccaccttcccaaatcctagctgaccccaagggctaacccccaatccaccctcccttcccagctctgccccagattaagtgaatctctttctctccagcactcagtcttatgttagaattatttatgtgggcattgatcttcctggattgactgtgacctgctgaaggcagcggtggtcctggcatctgccacagccccctcccccaacagcacttcatcacctccgtgaacggaagtgaatggaaggaacagctcaattaggatggcagaggatcaaggagagaattccacggacccaaaacatcctgcaaaaaggctttgtccccagaggttggtcttcaatttggaaaaattcctacctgagcaactgtaggacccctctgaaatggaacagggtctattagactcataaaaagcctcagtgatgagttggttattattattctctttacttttctgtacatttaaagtgttttatattttaaattgaatgtaaaaagatcccatcctatttaaaagttagtgagttgaataagtttcattataacttgattttcttcctaaaggttttcctatagttcaaattataaaagtcattcttagattcccagcttagttcccccatgaaatcacgagttcttagactgtgtttcacacaatgccaggtcacattgcacccttactgaaaggaacttcttgtgcagagtgcggggctcttggagaaagaaaagtaccacttttttagcacattaaaaacaaatccttgagctgttttattattttaatactttacctttagtggagcagaaatgatttatttgatggttttggcaggtgattttttttttcggaatcttctttaacactattagccatgtaactattgccaagtacataataagtactcaataattattattatcttttaattaaaatgtgatgcacttctaaactaaaggtaacttcagtcatgtagaatagaaagcaatgggtggagcttccaattgcttctctttggtattcattagaaatcatttttgaaactgagaagttgggggaaagatcagacatttttatggaaactgcattgatgacagcagagtgtaattttgttggtagtgatttgatacacaattatttgagggatttactgtgctcatggattagcgctgtgttgttactgtaacagaggattggcgcagagccctggcccagtgcaaagctctctaacatcgtttctcttccttcatcagcagcccaaagcccccctctctacaactccatgcagcacagtcctggcacaaacccctaacctgaaattccagccaatttcactaacaacacgcctctccccttcacctgccagatgcttctcgttctcagacactgcaccctgaaattgggagctttcactgagttaaaaaggcaaatatagaattacctagctgtatcagtattttaagtgcacttgtagacttaaatgagagctcttgtacaaaaccacttgtattctttcttaagatatgctaatttttttctctctttgattgaactgttgaccttctggatatatgactagttattacttcaagtatgtttggaactattcttgccctaactgttctaaaatgtaattagcattgagacattattgtagaagcacagcacctggggctgggatctcattagatggcaaaaattgagcagaattgtgcatgctccatgctcaaaatatctctaagaaaaattaatggcattagggggaaagttaaaattggtgatttcgtaggccctttcttgctcacatatttgattcgtataaggatccaaacagaaaggagattgtggttcttctgtttaaaaaatgaagacaactctgctttcttagaactcttcttatgtaatgtggctgctgtcacatctctgggtcaaccaaaaccaaaataatacattttctggctctagctttttcccccctcaagaaatgcatagcatttttaggcattatctgatttttccttgcaacaacagatgttacagagaatgaatattctgtaagaggtagttaacaaagtgtggaaaaactgaggcccaaagaggtactataactcacgggtttttcacgctcctccctgaacattcccgcatctcttctactggggagggagctctttattttctgaattgaaaaccatttcatgcctcctgctcagctatttcagtactggctcctaagtttggcaccaatcccaactgttatgaaatcgcagacgaataataacgaagttcttcattgctgggatcccaaaaggttatcatttcgagttcattgcagggcactttagacgtccatattgggccctaaatgattggaaccatcaggagagggcttgcctgactctgccattcacctcatttgtaagtctctgccgtgtttcgacactgagttgtgtcttgttgtttaaaaataacttctcattataataacattttcccttaattgaaaaaatatttctgacctgaatttattattgtcatagctgtgtgagcaagcagagtcttgtttgcctctacaatatattaataatgtattaattagcttcccagtgctgcccaaacaaggaacaaaaaggatttatctaaatcatgaaaactgaagtgaagcgaacactttggtaattatattttaagggcagtctcagcatttgatagtgtggcaaatttttgtcctgccttttgagagaagataaccaaaaacaccactcaattaacaaaacgttgtttagtacctactatgcacaaagtctgagaggtaaaagaggttaagacaaataaaattgtccaatttatttttatggccatagttaaaaggcaataaaggcaagacactgtgagtattttgatttagctacaattagctgaaatatactacatcaaatcatatgaaattgacaatatctgggggctggctgccgtgactcatgcctgtaatcccagcacttttggggcccaggataatcacttgaggccaggagttcaaggctacagtgagccagggttgtaccacggcactccagcctgggccacagtgtgaccctgtctctaaagaaataaaaataaaaataaatagaagatattgacaatagctgaccctattttttaccccaaaagtggtgattttatataatttaatctaatattaaggtattcttgtcatactgtaccagctcctaaacattatacttttcattttacttctatttctaagctatcattattacaacaaccaagagaaggtaaatacaggtcagagatttgactcctgttttttgtatgtatttatttttgtagattcacaaataacttatattttgcagttttaaggtttctaattatattagaccctgttttttattttatttagagtcattgtccttgctgcctgtccttcacatgtgacaagtcaattcttcatgccatttccttcacaatcttcatgcaaactcatcatctccatttccatctattcttcagagatgtatgattgcagaaaactccccttttttgaaatattgctcaatagagattaaatctaacacccagttttacctgtctatccttgaattacaggttactgagaagtcagaacagatagccatagaagtaccccactaaatccattcttctatctccttcaatatttgacaaatatttactaagcatctatcttgagcaagcattggagtaagtcctcccataaatatgaagttgtgtaaataaggatgcatgcattcatgtaaatacaagtttaatgctggatatatattgttttaagtgcctgatatgtattagtctatttattcctatctaaggggataagtgccattgttgtttccatcttaaagatgaggaaactgaggccagagagattatacgaactcctaaaaccctaactcttaaccacagcattcagaatctatctggttgtagtggaggacccaatgtcaaaaaagcaagtgcttttcccagaccatgaacacaatgtgtgacaaattagcagttcttccccttgccctaagatagtaaatatccacccaggccaacttgtgtctgtcagagaacaaagagtgggcttgtcacactgttttctcccaagagggtccatctgcctccgctcctttggtacacgctaggggacacacactgtccagcatattcttgcagagtcatatcttaccccacatcttatcacaaccctgctgaatgtcaggcactatcaagaaaatgttcactcatcttcttcccgttatgcccaatgtgtgaactgataacacatctaaattcaaagaaaatcaacagacatcacctcaatcaacctgaaaagtctggtgactcattcccacccttctcacggggctcctgctgggctgcctggttctccggaaccagcctccaggcctcctgcagccggggtgcagctcagtgttcgagccccctctctgctgcccatcagatgagtgttgactttctttggcacaggcatttgagttgcatttgaattgcagaacatgctgcccccattctgtgctgactgtgaccccacttcatgtgccccagaggcaggctaaacaagcttgccttggaaaaaataacagggaagaagatgctgactctccaacccccagagtaagttccgtcactctggaggtaaagtcataatatctaaatatggctcgattcatgtcaggtcttataaatacacacacacacgtggatgctgaaaccgtgcatgccctgacagccaaaaaaaaagtcaaaacgacttactgtctcattagcaggacaagacctgataggccagctcaccagaataaagaatacaaaaaatgggtatttaacttctctacacagacacacacacacacacacacacacacacacacacacacacacacacaatctgatgtaacgacctcaagagagctggttgccctggcaatgaagaatcgtttgtatattcaaggattttcttgtttaaatttaagctagccacttgaacttctcgagctttcttgagcttagcttcaggcctccatccccagacagaggtctgacatctatgtcagcctctagcaaggcaggaagcttagaagtcggaccaaaacctcacaagccagccagcctggatttgaatttcagctctatggtttctcagctgtgtgacctgggttagctgcttaaccaccttgaacctctatttcctcacctgtacaatgggaataataaaattaaaacaaacttgcatgggttcattatgaaaattagattgattgatgacataatacatagcaagcatttagagctgtgcctgattccgaatgtgagttatctgtaatagtgacttgaaatgggtttacactgcctggcaggaaaccattcaattcctttttgtttttgactttaatctttgaagcgctttcatctcatttcttcttattttgtgtttgtggagaaggaggatgtttagccatccttggagtacaatcttttattaaaaaccattattaagtctcttcaagtttctcttttgtagtaaatgatctagattacttaatggttctgttttacatgttttaatcatttatttgaaccatctccagatgtagtacacacagaaatattgtctaggaaaatgtgttactgaaattccttatcatctgtggtccattagctcaaatgtttaaaacccattgtttttatttttattatttatttatttagttatttttgcaagacagggtctcactcttttgcccaggctagagtgcagtggcacaattatagttcattgcaggctcgaactcctgggctcaagcaatcctccagcctaagcctccccaaaacttcttattcttaagagcaaagttgagttccatcatattgtcagttggtttcactccatcatattgccaaaaccacctaattctcagatgcatagtttagcacaagccaaaccagaagagaccataggtcattcattcattattcattcaacatttactaagtgactgctgtatgccagaggctgggctatgctgtaaagtcacaaagaagatacttctcagttgggagagcttacagcttgagagagaagacacacaagcaaacaaatcattacaaatgcctttccattgggtgccatacttgaaatgagaagatgaggccagggtacccttggggcagaagggagggaggattaagctcagggaacagctttacagagaaggtaacatttgcaccatattaaaggatggcaagaattgaggagtacaaaaaggagaatagtccaagaagaaacactcagggatgatttgcacattgtaaatttaggtaaccttacatgccttacatggggctgctgtgactgaggcacagggtcaaggaagggagcagagtcataaagctacccaggtcagccaaggccaggctaggaggcctgagctttatcctgcaggtgtgcagagccagaggagagtgcaagaagagacatggcacagtctgatctgttttgcacaaatcactctggaagcaatgaggaggggagaatggaggtatttgagcctagagtcaggaaggagaagtaggatgccagggttgtggggaaagacgataaagcccacacaaaggagggctgatggaaagatggaaatcaatttcaggtatatttaggccaggtgcggtggctcgcgcctgtaatccccacactttgggacgccgaggcaggtggattgcctgagctcaggagctcacaaccagcctgggcaacatggtgaaaccccgttctactaaaatacaaaaaattagctgggcatggcggcatgcgcctgtagtcccagctattcgggaggctgaggcaggagaattgcttgaacctaggaggcggaggttgcagtgagccgagattgctccactgtactccagcctgggcgacagagtgagattcagttaaaaaaaaaaaaaaaaattcaggtatatttaaaatatagtgtttagagacccattagtggaagataccagatttgagaaaggggaggaaaagacacggaggagtccagaagaaatttccagatttctggcctggataactgtgagggcagtggtgccagatagtgccagaatgaaatatatagattggcacaaatccatctctcagaaatgcacctctgagacatctgttctgctgaaggtcagtagggaaggccaacttcatgtgcaaagagcaatatgtgtgtatttcttactagctattctttttaaaatacttcttaatatatgggacatacatgagctaagatagtattcatgcaggaggtttcatttttcattttctggcaattgtgttttcaaatatgagatgctagcattatttcagttatctatgcctagcatagtatatatctacggttcaagattattaattgtctcccctgcctccccactagaaggtaagctttctgaagccagggattttgtctcttttgtcctcatctccattcctagcccttaaaactaagtttgactcccaattatcgagtaaatgattgaatttccatctgagtaaaaagaaacagtcatttcctttactaatgaggaaagaaaaggaaaacaacaaacaaatctggacttaaaacagtttttacaaaaagatccaatttgcaaaaatggaactgaagtttaaaagctacttttctccctgcagctctacttctgggaaagtcacagctgccagcttagatggtggttttcactgcccggttacaaattctgcacagttgtacatattggcagggctcagcttccttaaatgccattggatcagtagggaaatggtgattttccttattgatttaatgccagttcctcttttatgaaaaatcccacgtgctgctcactggcgtatgtaccataaaaactgaacgtagggggccagaaattaagtaagtcactcatgttcttctccagccatgtgacgttaaaccatctctactttcaggctggagtgttcaatcattctccctttaaatttagcagagtgattattcctcctggtggattgcacatatgctcctttgatctatgaaatactcattctggatgaactttaagctcccaggaaatgcatgtaaaatactgtttataaatcgcgggagaaatgtttcacattcttattactcccaagtaatcataccaagcctctctctccaagattcgctttttttcctagaagagggaaaaagaacttcgggcagtagcactgtgacaatcatcaccacggtcgtactttccatgagttttacgcagtaggctcacggaagtgacaatgcatggtcgggcgcggtggctcatgcctgtaatcccaacacttcgggaggccgaagtgggtggatcaactgaggtcaggagttcaagaccaccctggccaacatagtgaaaccctatctctactaaaaatacaaaagattagccggacgtggtggtgggcgcctgcaatcctagctactcgggaggctgaggcaggataatcacttcaacccgggcggcggaggttgcagtgagccaagattataccactacactctagcctgggtgacaaaacgagactccgtctcaaaaaaaaaaagaagtgacaatgtaggatacccattcatcagcaaatatttaatgtgagcaggacaatgtgctaagtccatagactgcaaagaggagtgaggctgggttcccatcctctggggcttacaaggtagctggagaagtaaaactcaaaccacaaagtgaagttaatagtcaccaatgaacaacatagtaagctctgcactggttcagaagaggacaggagtaacaagacagtaatcctaaaggagatggacttgaatttgagctggacctgaagagtcaggagctagagtgagtaaaggcagagtggtgggaacatttgtgaatcaaagctcaggtgggggttacggcaggcagggtggggatagactgaggatgactttgaatgccatgccactctaaggactttggacttgactctacaagcaaggtggaattattaagagattttgagtagaaatgatgtgagctgaacagtgcttttgagaaactaaatctagcagggatcagtgctccaaattaattggacatgtttcagacttgagatcatgagaccctgacccaggctggggacaatgggatgtctccatcatacattacattcctgtgaatacttcttacagattcatatgaaattctgcctcaatgtgcctactgtctctgcactgtaagacagtgatattgtgatcctgtgtgctgcttggaaccagcctcattcctttagcaccccagtttggacttggagtgggcccaagtgcagcctgtacacaaacctcaaagaatccaggcagcatagatgtaaaagcttggagccctccaagtccacctcctcaacttaccaagaaataagctaactcttgctcatctccctaatgacggattcagcatgtggcctcagatcttcctgtgctccagcagtgcttctgaggccagtccaaattctgctttgaggtgtgcgtgtgccaattgtggtgcaatccagaagcattttggacgaatgaaggagctgtttgtgttttcttgccctaattgagatagttgaagctcctctcccttactctacaccaagccccccagatccggtacctccctgagtccccgacttcatctctgccttgcttcttttccacaacaccctatcagttcttgcatcctgccattggttgtgctgtcctcattatctgaagcctttacctcccctcttaggcctcatcacctccaggagactctccatggcctcagcccctcccttaggtggaccaagcttcctccttggagctccatgctaccctgcatagggctcagtcactttgcctccatgatgtcttgcaattgtctatttatatgtctgcctcctgtccttcaactgtgagctccctgaggaaaggaactgtgggtatgcatcattgaatactcagcatctagcacggtgcctggtacacactaggtattgaaatgtctgataaatgaatgacagttgcatatttgtctttttggtatattcattcatttggtaaatatttattgagtaattacttataattgaattggcgctgtgtagttacacttaaacatcaaaatgagcctatcctctcaagctccaaattatgcatgcataaattatacatgtgaagtgttaacatgcacacgcagcagagagtgtgcgtatctacaaataccagagctagcaaatgaaataaactgtgtgccagatgtccctgaaatttacaaagaaccaagaaccaaaaatgacagttagctccgtaagcccaacaaaagaaaaaaaaaaaaaaaaggaaaagagcaaaaaagcaaaagaacaaaagaaccttgagcataaggaagtggctatggttttttctacatgctctagctgggggtggggaaaagtcataaaagcattctatgctggaccggttcgtgttaagtctgagttcctcaatcgctggctctcaggagctgtttggaaaattcgttgccatgcatgagtcgggggattggttttttttccactggaaattgttaatggggactgcattagcggccccttatcgctttgcctgatagagagacagcaggttcgcccaaacaattctggaaccctgatcactgccaattaggggagtattgtctggctgacataatcaagtaagtataaatatatttatcgtgattggaatggggaagggagactgcagaaagattgaggcagaagctgccacccactgcctggctccagcctggatccagcccagtttgtcaccctgtgctcagcagaggcggtcactggctttctgaggtggaatgcacagttgagaattcaggactagaattgcttctcccagagagaaacttgtctcttctcatttttcctcccctcttcttctctttttttcatgctcacttctgtgagagctgaaaagagaagaaaaagcagatgccacgttgatcacgttttaattctgcccccccggccatgctatccccacttaccttctctgtagtggaaagtgatggtgaggcacagtgccctgactggacctcccatcctctcggcccgccggcatgtgcaagttggtctggcattgggtttatttcattgttgatttgtggagctttttgggaatacctgtgatgtgaatcagccctgggattgaaagaccctgaaaaaacagtcccttgcagtgggctagtgacgggaggaattgctcacatttaaacagctgaaaagcagacatgtttaagtcacatctggtggcattcctgttgtctgaatggagagcaaggtctttttaagcatctgcccagatttcaaaatgcaggctgcatcttttcttcctcaaacaaatggtcaggatcggatatgaatggcctaatcgcatcgggagaggtaaacaaaactgatctcatggctggatttcaaccttggtccatccaggcccaatcgatctaaggcatgacttttttttttcctctcacccatgactacttgataatggccatttccggggccaagttcatttcggctcttttccaccatcccccgtgtgctgccctgtctcaccacttgagggctgaggccccttcccaatggctacaacagggtaaggggaccctgtccttctgtctccttcatcctatagtttgtcttcacagctgcaaattgctctcaggcctgccttcctggatttgacaaaaactattttcttactggtactatggataccacaagtggagatgtaagtaggaaggtgcaggtccacaaataaatagggagcccagatgggagaaatgtcattagagagatcactgtccctaaaggcatctgaccacccatgttcctgcctctttctgcgaccattttcctccttcggctgctcagaaattgtcgaggccaaactcctttcacccagattccagaaatacacttatttcctttgctttccaaatcttaatggatgaaacacctctttttttttgtcttctatctcttgccagaaatattgttttttgagaaccagagctcatttatctccaagggagaaagaaattcattccatgtttacccattaacaaattaccacttacatgaaaatactgggacttctctcattctttgctaataaatgggttattcaccttggttgaaccatggcagaggcagatggatagccactattcccttcaagttggcttaatattctctcgttggcttttgtctccttgaagcacagagatttctcagagctttctttgcttgattctgcttttaaggaacgtgcccaacttatttgagtctgtttgtttagtaagctgaattgattaaatccctggcatttatggaggagcctactgtgttgggtgctatgggttcctccccacttgaaagttgaattggagtcacccatctgaatactaactccctcctaatccattggttttcctgctgtgtagacaggggtatgaagtagccatttaccaagagatagtgcgatgtcataaaccgaacatgagttctaaagttagcaagacctggtttgtacagtagtgcaggcttgggcacgttgctgctctcttttgagtcacacattcctcattatagatgctgatgggaacaacagagctgtctgttcatctttgctcttctccataatgagataaagccaaacagacagtgaagagcctggtctaaccacataacgttggtgcaaattatatatggtcataagaaggtaatttttacctgagcatttaggtggcatttggtgtggtatttgatgcatgtcatttagttacagagataaaacctcctgaacacacataaagctcttggcctggttgaacattacatctcacagatttttatgttttttactaaggatacttcctgctaggaagttgtaaaagagaagatggaagtctttttaatggtattgtagcaatatcagtttcctagctttgatactgtactatggtgatgtaagatgtccccattaggggaagtggggtgaagagtacaggggacctctgtactatttttgcaatttcctgagagacagagggaaagagagaaagagagagagagaggagggaatgagtggagtgacatgaaaaaggagtgttcatcttggcttatgtccctggctggacaaatatttacattttgtttgcctctttgtatagattttgtgaatagtcatggttaaaagctagcattcccttttctgtggaagagaagaaagataatagaatgagctgagaatccctgccaacattatattagaaagccacctacttcctgcctctcctcaccctccttacctatacaaacttaccttctgcatctttgtcctccttctttcccattcaaaggggagatgcgtctcctgctgaacaaatgaactcctccgcatgaccaaggtgtcccatccctccctgctgtctccaaaggttcagtcctgctacataatctctctaggtgaattccttcttactcagggttttcacaatcatctatattggaatagcacccaaattaatagctctacccagacttttttattgagttctatacctgcatagccaatccttgactgggagtctctacatagatcattcacaagcatttcaaacacccctttaattatctcctctttctgtattcccttatctcagaaaatgctaccaacatctaccctaatgcccccagcaggaactcaagagtcgttctagacctatgctgtcccaagtacttcaatgtggcttgtccaaattgaaatgtgctgtaagtgtaaaatacacaccagatttcaaagacttagtttggaaaaaataatgcaaagtatctcaataatattttatattgatttcaaattgaaatgataatattttggacatattgggttaaataagttattaaaaataattttcttttactttttaaagtgccaccaaaatatttaaaatggcataatggctggcatttgtgacttgcattctatttctattggataacaccattctagactcttttctgtcttttagcccccttccaactggtcataattcacagtgattcccttgagttaagacaagggagaatactgtttaagtgcacaggctgagtttgaatcctggctccaccattttttgatacatatgaacttgggtgattatttaacccctttgagcttcactttcctcatctgtcagctggatacaatagcagttcttattttgagattcttgcatgctttaaatgagataatgtgtaaagtacttactatggagataaaaacatgtggaaagacccagtgtcaaaagaaagagcatgatctgtcactgttgtagttcaggccctcatcattactagccaagactactgcgatgctttctccatcttcggttcaccctgccctccattccttcatactgccatctgattaaacattcctgaatgcaaatgttttcaaatgtccaatgacttcccatcatccttggtatgaagtcctaagtccctggcatgctttcaatgtcctccatgatctgcccccagtccaatcactgatcccatctcctgccagtccatgattgaaccagttgggtccccaactcctatttgcacacaccattctctctgtgtgtcatatatgagctctctactctgcctagctacttgtctgcaagactcagttcaattgtcacctcatttgggaagcttccactaatccctcctgcacctgtctccgtcctaggctagattaggagcctgccctttgggttcctgaaccacttgaggtgtggttcctttatcatgctgatctcactggtttggctgacttgtttttcctacaagactgaactgtctgaggtcttaagatgggctgtctagtccacactggatcttcatgctctacacagggcttgacacagagtggggcacaggaaatgtttgttgaacgaatacacaaagcatatggatactcctgagagagagaaggtgggcaagacagccttgtgaagttaagcagcagaaaatctgaaaacgaacctggatagaaatcaccaattcctggaagtacagagagaggaaggagagagaagaatctgtgcaaggagtcagtaatggaggacttgaaatgaaaggctattaaagagagaagatcattcaaacaacagaaccacatttggtactgttggtggttttgtaacttcctctgaaatggttccaggaagagacaaggttctaggatggtgcaaatcatataaagaaaggatggggtattataagccaattcaaggattatttgtcatcaggactagatacatgggtggtacaagtaaatgtcaacctgatgactacacgatgggactagtaataatttactggggctggtgcccaggaaattttttgctgtggtgcagatgccaagcatggaaaaatttgacgagttataggcatgagaaagtagatggcgaatttgagagtaacaatgtaaaatgccagagtaatcacaagagaaatgtctgaatatgtaagagagtttagaagatttctgctttaccacaaatacggacttcaagaaaaattcccttataagaacagaaattccaatatataaaacttatttatcaaaacacacagtattccataatatataatggtaaaagcatgccttttgacccacacaatattaaaagcagcaaataacacaagaaaggtagagaaaacagaaggtacaacattttgtggctcacaggatatatgagtgagattatatacttctattccaaaccacaaccttcactagaacatctaaaggcttcattctagaaccttcatactgcttatcccaaaggctagcccactccccggttttcatgtaagaaatcttgtgggacaggcgttgcatgaggtgaggggcagcagggaaattcgagatgaaagggtgaaaagatcaaacgagtccttgctattcttcttaacaatgcttcagtccaccactttgagatttctgtggagaaagtaaagatttgggatatacatatactaaaacaactattggttgcttatctgaaaattaactttagctgggcattctgtattttatctgacaaccctacttggtgaggtgtacattttcttattcatacttcctgcgagccacaacatgtcttaatagttgttagctattaaggactatgcataaaagtgacaatagctggctgggcacagtggctcatgcctttaatcccagcactttgggaggctgaggcaggaggatcacttgaggccaggagttcaagatcagcctgagcaacatagggagacccctgtctctacaaaaaaaaaaaaaaaaaaaaaaagctggatgtggtggcatgcacctgtagtcccagctatttgggaggctgagacaggagaatcacttgaacctgggagttggaggctgcagtgagccctgattgcctcactgcactccagcctgggccacagaatgatacctgtctcaaaaaaaaaaaaaaaaagtagcaatagctaacaactattgaattattgagtgcctactatgtgccagacaccatactaagtggattagatggatattccacatattcttcccaagaacattatgaggcaggcactattatcatccctgtttttaaaatgaggaaactgaggctcagagatgttaaataacttgctaagggtcactcagaaaactagtagtagagaagggtttgaatgctggcagcctgactccaaggctcatgtgcttgcctaccttacccagatggcggcagcactgagcaaggggtagataacttcaagtcccctggaagaataagagaaagtgagaccatggggtatgaggggggcaggccctgagtaaagctttaaaggagcagttgaaattagacccggtgcctttgtttaagtaagaagaatgtgctagttctaaacagatgcagccccatactgggactcacagcttgatgagaagcgcactggatgcatttcagcccttactgcaacctcagcctgaggcctttatgcagtgagcaacctgcacaaccatacatagcaatgtgagtttgatgggagaaggaagaccagtgcagagacaaggatgtcgatggagtgcttagagaacaaagggaagctatttactaaagcatgtttgcatggtgcaggtgattttctaaagttaattttgacagacaggatggggaaagattgttgaaggcctgaaatgacaagagagacttgagtggatctgggaggtcatgtgacaaacatgacattaacaaattctaaatggaaaaaatgaccctcagaaagttgtgtgtcaaggccgggtatggtggctcacgtctgtaattccagcactttcggaggccaaggcaggtggatcattagaggtcaggaattcaagatgagcctggccaacatggtgaaactccatctctagtaaaaatacaaaaattagccaggcgtggtggcgggcacctgtaatcccagctcctcaggaggctgaggcaggagaatctcttgagcctgggaggcgaatgtttcagtgagccaagattgcgccactgcactccaacctgagcaacagagcgagaccctgtctcgaaaaaaaaaaaaagaaaagaaagaaagttgtgtgtcaaaagcttcaacacacaggggcctttgctctgtcaagcaaggagaatagggtggaggaggaacaggaacacagtagctaaggtgacagctgcctcacaaaaggaaagtctatggcttgcaaaagaggtcgaggaaagcggaaaagcaattgccgaagagggacagtaagtgaaaagatgagtttcttccacttggcatctccccaaatatggccctgaaggaagagttgaccctgttacggtttctttctttttcctgtggggttattagagtgacatataagaaaagggccacaggcacggcacagcttgatttcagccaggctttgcatgacaccctacagagcagaatgaggacagataggctgaaggataactacttaactgggtaggtttcaagttgatactcagagtgttgattaaagggtggtcaatgacaacctggaggaggtctttaggtaaagaaactgagttcaaagataaccaacttgcatgaatgaaggagccaggatttgaacccagccctacctgattcaaaagtccattttccatttattataaaacaaaaaccaaaaaggcatgaagttcacttatgaaagaagagttgaaagatataaccagagggttaggagtacaaatccatgcccgaatgaattgtgataggctgagaaattggccaaagggggagaacaaaaacacagtgaaagtcagaaaggttaaatgtgaagccctgcattttggtttcaagaaacccgttgcagaggtggagaggtccagcttgaccatcttcatgttgggaagcacccgggcttttgttgtagttattgttgcttaattcccaaacagcagcggggtgtgggggcacacgattgtagccccagctactcgggaagctgaggcaggaggatgcctaaagccccggaggtcaaggctacagtgacccatgatcacgccactgcactccagcctgggcaacagaacaagaccctatctaaaaaaaaacaaaagaaaacaaaaaaccagccaacagtgtaacacaattacaaaatcttcatgtacaaatgaagtgattaaatcatcctattctactcagcccagctcagaccatatcttgaatactgggttcaagtctagataatgtattttgtattttgagaaaaatattgaataactgacaggagacctgaggaaaatgaccaggagatcaagagttggaaccttgtcacatgaagggtggtcaaggactctggggttatttcagcttagaaatgggaatttgggatttgtgattctcattttctgtttcttttgttcgttcattctttctttcattctttctttttctttcttgttgtggttcttagcacagaattcagatgaaagagcttttgattcaacgtaaacaattcaccaagctgtcagctcactccaatcccagccgtccccgatgcccattgtctatcatctcaatgaattagggaaaaagactgactttctgggccacttccaactttgagaatctaggataggggcactatttaatcaaaactggcaagtaaaaagaaagagaactattttaaacaagacaaatacaagaggtgttgaaccaaactcaaattagaaagaacaaaatttcccaaaaataagaatattataattcatttgatgaaaggaatttgccatattatcccttttactggcatttttttagtacctttacttgtaaaaatgtcaggccctcccacttttctgggatagacttatcgaatgaagcaaggggagcttctctatggatagatgatcacttttgcaagctttgagatcagtgagctgaaaaaatgaccagcattccaacaacaaatgagggcttgggagcgtaagtaaaagtgacagcaagattaaagtaattgtggtcatgccgtcctctgctgacacttttgtgttttgcccagatgagaattaaggtagcccagggcacaggcagtgaggaaaaggagaggggcgctgagcgtatttgcagcatttgtgaaccatgtcacagccctggcgaaaacagagcaagaagatggaggctttcaaatccatgataaataagccatgctttcagagcccaaatcagtaaaaacaaacattaagtgaacagaagggaagagggaaaaaaagagaacatgaggccaccataaaatcctggtgatatattccaggggaaatcatgatgtgaatagaaaatgagaagtaaaagaaaatgaagcctggagatttgtaaaatgtctgtctgtctgtctgtctctctcgactgtcattcccatctacccctgccacccccaccccgccctccacccttctgatggggttcattagatgatttctgattcaggggtggggggcggtatttttaatgcttcacttatgtttgggttttgccagcaggatccgaggtgtttctgtagacaattgttattgctttaggaaacaataagaataaaatgaggaaacatcaagtgatacatcagtctagcagcagagtgaggctcgaagtagcatttccagcgaggttggtggtctctttttgccttatttttgttgttttggattgatgttttcatggtgtcattttaataagaaaagtgtcagagaattaaaagtggaagtatgcgagatacactttctctaactggattcatggtaagttattaatgtttcaaggagaaagaaaagaacttggaaaaagcagaatatattgtggggaaagttgatgaagggaaaggtaagagaactgtgacaaatgagacacagacagaaggagagagagagaaagaggaagagagagagacagggtggtgggggggaccggcagaagaaaaggaaaagagcgacagtttgtaagtctattagctgagattgtttccatttctgcaattgccttaaagcgcatgattgcttggtctgaggtctgccaggtcgattgcagtctttacctctttgaccaagaagtaatgggcttgaatttcctgggtatgtgaaaattgctcttgaatgttttggctaaaggacagccacccaggaaggttgagagggcctaagctagtgagcagtcatcctgaccaagtaggagggatttggttatgttgctcgtagcaggagaggcagagcagcaaagtgaagagaacacacagccttaggtgccaacagacatgtactgaaatctcttgcctccatttcccacctctaaaatgcaaaggatgatagtaacaataataaatgttgcaacgggtgaccgattataaagttcttgtcacctgatagaccatatcaatccatggtaacttattcttagctggttcacgtttctaggcattggcacagtctgggtggtgtgtgtcccctcaaaggtagcatcacagtgactgagctctgcatagatggcaaagtgtagaagcctggtcagttttctgtttctccatccaccatttctccccacttccccttggttagtgctgtcttctctctttcctcactgaattgtcttgattagtgtcatactttctgataacactgcagctaggactccacaggcaatagggagaagctagcgcctgcccagggaaagtgaggaaaaataggtgcttgagaggctgaaaagtagtatacgcttggtggccttacactttgtagaaacagttttggatttgtctctacaagaaaggattgtagataaccagaatgcaaaaatgctttgaagaaagagacattgagcattggaaccaagtattctacgtcctcttccctgcaacactggggactaaggattattatctgcatttctggtgaagaaactgaggcacagagaagataaactatggttctccggctacaaagtaagcagcagagcctagagtttgaagccaggtctgacacctaagtcccgtagtaaacctcccactgaggtaggcaagcctcgccttgcagagagtggcaaattagggaaaaaagaatcaaatgtgcttgagtttaacagaacatatacattatacttaaagagaaagatacttttcttacaaaaagtttgaggacaaatgagacttcatgtgatgcgtcttgcactaaaaaaaaaaagttagattatataagccagactggcgttgattaaagaagagcaaggtaataaatacgcataagaagaaggaagtggctggctctaccttgggcatcacccaagttacaggcaggggaggggataggccctgcatggggacagtctcctgacttgtcttcttccttctctacttccctcccttcactacccctccctccaaaacccaaaaaaccttaagcaggaaaaaagggagctaattaaaaaagagaaaaacatccttgagaccaatgaagtctccataatccacagtgacagacagggacctgcagaacagcaatttgattaaataaggatataagggatttaaaaggactctccagttgtgtaaagtgtgtccatacgtctgaaaaataccgtatttatttggctcccaaacctgaaaaccttctgacgggggagattgttcccatttggaaactaggaagaaatcacaaggcaaggccatggggttctggcagggctggggatcccatgttgggtggaaaccccaagaagccagccaagggtctgcaggaggggccctggcagagagaagcattagaatgcaagggcaggtaaagccaccctcacagaaggtgactgtgggctgagcctgaggcccttcccagatggggaagagagaacagcacacctctcctgcccacgcctcggtatctcactcaagaatcagctgcccgttagtcacctgtcatcggagacagctctgttggcggctttcagaaaaagcgaagcagccagaggatgaatcgttattcggggaacacacctgcacacaggacaggaatggatgggagtggggagcgccctggggctactgttcaaacgccatcctcatggtctccaagacttgcatcagcagctcagccgctgatgaattataattctcggacaagctgcagaggcccccctcgttccatgtgttcacccctgccgctcatactgggggatttatgcttcctggggctaggaggagaaaataatgagtcactggggacaagagaaaaacaaaaatgccctgtatgtgcaaaaccacctaaaatggaggcttttagaggacactcaaatcccagccaactagccagaaagggttttgctgggggtatattttatgtgtctttgctatctttggatgcagtaaagccagaaatgtttatatctcttggagggatcacctgtgcaaacaggacaggtcctcttgagaaggctgtttgttctcctgggatctcgaacctgagaagaaatggtcctggcctggcgcggtggctcgcgcctgtaatcccagcactttgggaggccgaggcaggcagatcacaaggtcaggagatcgagaccatcctggccaacacggtgaaaccccatctctactaaaaatacaaaaaattagccgggcgtggtggcaggcgcctgtagtcccagctactcaggaggctgaggcaggagaatagcatgaacccgggagctggagcttgcagtgagtggagatcttgccactgcactccagcctgggggacagagtgagactccgtctcaaaaaaaaaaaaaaaaaaaaagaaatggtcctgcatctctgacttgggaggtccaattaagcagaggaactgttggctgtaaaccttctaaagcagaggatcctttgggaggctgaggcaggtgatcatctgaggtcaggagttcaagaccagcctggccagcatggcgaaaccccatctctactaaaaatataaaaattagcggaccgtggtgggctgtacctgtaatctcagctactcgggaagctgaggcatgagaattgcttgagcctgggaggtggaggttgcagtgagctgagattgtgccactgccctccagcctgggtgacagggcaactccatctcaaagtaaataagtaaagcagaggaccctgatggccacccccaagttcatagctacctgcacactttatgtggtgaagcactggtggggggcccaggaagccctgcatgagttggttgtagctgccatgattccaactcccacgccaccctctgcacctagccacagagccgcatctccagagaaaaccagaagcaagaccccaccaaaaaagaatgtgagagtctattttaaaggctccggaagatgagttagaagtgattcaagagcaggcacagtaaaggaatatgtaagccttggtagacattcagtaagaagggtaacatttccaacatgaccagctgattaacaggtattctctaagcagggtgtctgctggtttagaatagagcaaaaatattgtcatctgagagcccaaaatggggaaaggctactccttggtctcttggtgaggcccagcctgttttgttttttgtttgttttttttttttttttcactttcccactttattttcagaatagattgatttgggtctctagaagaatatttaagcagtggcttacaggcgagccataaggtagttgtccgttctatgcttacaaattttcaagaagggccatctgtaacctttctcagtttcctgttcctatgtccaatgcccaataagaggtaataaactaaggcagaaaggccccaaacacagatgtaagatgcagagcaaagaataacacacagtaggggtttcaatacaggatcattaacccagaatccaagcaggagtgagggaagtccactcaggaggaatgggaaccacctctccaggctgctcaggaggaatttaagcatcagacagtgtgtaggagaagatgaccacgaattctttgacatctaagcaattctgtattttaaaggtttgagtctttgaaatgttaaaattgatgcgccttaaaactcatgagagacaatgaagacaatcaccgaacctgtctagttaaaggttaccgggactcaagatgcaaagaaaagttacgagatggaattgatggtttggggtgcaccattgccctctattggattttaaataaatcagacctcttagtgtaggtatgttgcactatctctggctgagtttgctgagaagtcagggcacctctgagtgggaagttaattgatccttttaaatggctccttctgtctcctgctccttccctgaggaaatcaaccagagtaatgctgagggcaggtcatttgcatgtcttcattcatccaacaaacatttcctggctgcctgctaagcccgggctaggcattgtagagaatctaagaaaaaataacaactgccattcgttggacacctactgtgtatcagagtctacgcattaatacagaacaaccccacggagtaactctggtgactcccatcccacggatgtggaaataggacactcaggaagtggcacattttggattcaaatccaggttcgtctactactaggcctatattctgtccactaaactacaacttttccccttaagaagtttataaactattagggggagataggatatagatataaatgtatatatcagggtttgacaaactacagccagtgggccaaattcagcccatcatgtgtttttgaccttgagctaatttacatttttacatggttgaaaaaaatatcaaaagaataataatacttcctgtcatgtaaaaatgctatgaaattcaaatctcagggtccacaaataaagttttatgggaaccctgctatgcccattcatttaccatcatctaaggccaccttcctggctacaaaaacacggcgagtcattgtgacagagactagatggccaacaaagccaaaatatttactctctggctctgcacagaaaaggtctgacaattccacatctgtactccaaggtgaaatgttctatatcaacaggagaggtgttttttttttttgtctgtttgttttgttaagtgcttgaggagttcagaggaggggaaacaaatgtttatttggcccacagtgtgcagagctggaggggataggcaggtgtgctctgttttaagactcaatgcatgaaaaccctgactttaaaacagataaattaaaaggtagttatttgcataacaaattttcctttcattttataaagcgattcaccacagggttcctttatagagtgagcctccataatacatgctaatatgattccatttacaaatactctattcattataacttttcaagaatatacctattgtgtacagtgaggcttaactgtaatcatttttcctggcagtataaggtttcctacttctgaaaagtgattaagctgaccttgtcaattcgactgggggaggcggcactctcctctactgtctccgagaggggctttacctgtcgaacaacaaggctgtggattctgtctctgcattgtgtgatgttgagtagctggtataattttacattttcactaagctcctctcagtagtagcagcagccaaagtcctaaagtgtaaactactctcactattctcttacttcatttcgtatacaagatacactaataaaaattatttgttggctggaccacggtggctcatgcctctaatcccagaactccaggaagctgaggcaggtggatcacttgagcccaggagttcgagaccagcctgggcaacatagtgagaccccgatctctaccaaaaaaaaaaaaaaaaattagccggatgtgatgacacacatctgtggtcccagctactcaggaggctgaagtgggagaatcctgtgagctaaagagttcaaagcggcagtgagctatgatcacaccactgcacatcagcctggtcaacagaggaaaactttgtctctaaattaatgaactaattaattaattttgttgctgatgtcctgacaaatatgtgacaagcaattcttgtaaaaagcaatgtttccctctctttttaaaaaatttcaagacattatcttatctgaattacaacataaactggggcaagtattcagattagagctctccccagcaaaataggaagtgatagcaatttaggacctgtctccttctctcactgggtcctgagcctgaatcttcacatagctttgtggtgttatgcaattgccctttgtaagagatacataaaatggaaaccttagctattcatagccaacttaggaggagctgaatttgatcaagaagtttcttgccgggtgccattttgatggtaactacgtgtttctgaacaaatccacttataatctgggtttccaatggaggttattttaaagagctgtagcatggcttttgttttcatcctctgtggtggctatattttagaagtagacaagcattcctggtatatagcctgaatattttttaagatttttttggtagtaaaagaagctcacatggaaaggcaagggtagaaaaaatcatgttcagggcagtcctgtgtggcattaccctctggtgaagcagatccacactgcatgctgctaatggctattgcgtgacagctcttaaaggggtaagcgagagaggtgcagagggctggtgagaagcagagctagcactgaggccctacaaatggcatcaccatctatcaggttggcggggtgggggttgggggctgctgctggaggtggtttggctgcccctagaggctgcagcgtctcacactgtatgggcaggtagcatttcagccatttctaaagcccatcactggcagggaaagcacatttaatccgtctgtgaggttctctaaaaaggggcctctcttttctttcttttttttttttttttttaagatggagtctcactctgtcgctagactggagtgcagtggtgcaatctcggctcactgcaacctccacctcccgggttcaagtgattctcctgcctcagcctcccaagtagctgggactacaggcacacaccaccatgcccagctaatttctgtatttttagtagagatggggttttcaccatgttggccaggatggtctccatctcttgacctcatgatccgcccgcctcctgggattacaggcgtgagccactgtgcctggccgaggggtctctcttttcagaagtcagaagcgctgaaattgaaaacagcagcaagaaggcttcattgcattcttgaattcaggctgttgcactccgccccccacaactctgtctaaattgttgctacccagtttatatctgcatcatattttttgttgttgtttctccaatgcagtatgtagtggtggcaggtacagatcataaaacaaatggataatcagattcctttttccctggtggtaatttttaaacttttcaaaattaatgctaatggatatagaggaatgggatatacatttccatgcatttttatgaccaaacagaaaaccgacccctgagggtgacatatttactattctctactactaggggtgcttcaagggaagagtttttgaagccctgtggtttaaacaaaaagagaacataccccaccccaccctgaacaaacagcagctgggcagatttcatctcacaaatggaaatgggagcaaacaaattttttcaaagcgattttataaagagtgggcctgtttagttgggttttttgagccaggattaatattacaagctggggagctctgtgacatggctgtgtcgttggctttgccataccgcctacctcctgggggaaggcagaggaaagtgctgctattcagaagcaattttacttctgcctcggccttctcacttctcactgaagtgatttacagccagcctggacccagtgcccaagcctgagctgagttacatgtcatgttggaaagatcttccccaaatcaaggtcttatctagagcttgcctgggatattttttcatttctaatttatgtaactttctaatatgtttagcatttgcccttcccttgtctccatcctgcttattaaggtgaatttgcatacaaatgggaccttggtcttcaggaccattcacctgacacttgatcccacgaggcgaccactgtctactgttgataccatgaggatgacccacagaagtcatgtctctctgcaaactagaggcaaggccttaattagaagaagccttgtgtgttaaaatgatggggtgaatcaaatcagcaaaggcatttagcattaacttaggagggcagaatactccttcctgttgagtgggtcgtcctaggtcacaacaattttaatttgccttcgatagatggatcttgaagaaagtgtacaaaaagtatatttgtgatggtgttgtttgggagtacgttttgactcaaagagttaactgtgacattttactttggctcctggtctattttttgcttaacatctacctttgaatgggtaatagtcatctctataaattaccttcgaaagattgaacaattgtggagaatcagagaaatgagccccttgctatcaccctgttgcagtcggctttaatcctctgatctcctggcgtttcaccctctcactggcagccaccttccttatttacccaaatcttgttaacttgggtaggaattcccactgagaggacaaatgtggtcccagttgactggtcgctgaaagtctattaggttggagagtatttattttctaccctaaagggtttgaaacttagggaaattttgatcaacaagaaaataacagctttcaagattgtcctgacagttaagctgtcttagcagagaatcacaggatttgatagtcatggagattagttctcaaatttcaatgagaaaagttcataggagatggagtgaggaaagaaaacttgtgctgattttggtcaggctacctttgctggggaaaaattcattccataaaattattttaaaacgtaaatactatttagctttatctggtgtaatactttgcatctataatttttttgttttgttttgtttttgagacagagtcttgctctgtcacccaggctggagtacagtggcatgatcttggctcactgcaacctctgcctcccaggttcaagcgattatcctgcctcagcctcccaagtagctgggattacaggcacgtgccacggcacccagctaatttttgtatttttagtagagacagggttttgccatgttggccaggatggtcttgaactcctgacctcaggtgatctgcccgcctcgacctcccaaagtgctgggattacaggcatgagccacagcgcccggcctgcatctataatttgatttaaccttgcaactttattaattgaatattatgatcaccattttatagatgaggaaatggagactccaagggtttaattacttgcccaagagtctacagctatctaccaacaaaactgggattggagccagctgtcttaccattacatccccgctgcctcctaaagcacagctctagttcatactaaatgtattacataggccgactcatttatctttacatgggtctcatgcattacaagaagggggccactattttaactcaattcaaaaatgttaaaatcaaaattcccaaaatgtacttggtttataatatatcataaaataagtaatctgaccaattgagcctcccaactcgaagaccaagaacttctttctactcccaaaccatgcagaaggaagctgagttccccactggccaatgctgtctaattctcttaaatgattcagatgtaaaagaggaaatggcatccgtctaattaacactgcctggttaaatatagctgccaagggacagccttgggacagtgtttacagaatagtctttccagcccctcaggcctcaagttacagatgatagcaagccttccctccttatcagctgcaaacagagatgcccccaaaagtggtgtcaggccaggatgatgaaaggagaagggaaaggctgcggatggccttcatttcctgctcctggcatctggggattccgagaatgatcccaggacctagatcctatagattccggcagctcttcctgcaaacacaagcccttgttgtgtgcctgagccttgctctccggcctggagacatccatctgcccactctcctaggaactgctgattaccaggaagcaccatcggctctgctgccctccccctggcagagaggcacaatgaccacattatttctcttccagcttcacgttacagcatggaagctgttgccaagtttgatttcactgcttcaggtgaggatgaactgagctttcacactggagatgttttgaaggtaggtgacctggggccccaggggagcagtagggagtttcagttactcagtaatctgacagtccctgcctttgtctcttaagaactgcatgtggttccttttaaaaagagaagttcaccttgattccctttgtgcacccttataccagacaccaaccaggccgggtgatggaaatacagtcggcataagccaccatccttgtcctgggaggttcgtagtctggagaggggaacacatccacccaaagggctgttacagatgttcttggctaagttctcagggagcacaggtgagggaacaagtgattccatcttgaaagatgggggttgtaggagtgtgtgcaatgtgaacgtcaggaatgcactgaaggtgacttgggcttttagctaaagctcagagatgtgcaagcccatgctgaatgcagggagcagcgccaggctcagcagagctggaactcaggaggagaggttgtgggtggagacagcttgggaaaggcagccacagaggacatggctcaacaaaggccatgcacacctggccactcaggggctttttaaagcttgtcctcatcctgcacttgagttgtagtggccacttgctgagctgaagtggccttggacttctcccacattcatgcaccatactttcagactctgcatcttagcccttgggtttttgttttgttttgtttgtttgcaaaagagcataagcccttcaaaagggcatttgggagtgtgtggagccagaccccctctgcctgacctcagagcaccctcagatagcctgatccctggtcctcagatagcctgatccctggtcctcagatagcctgatccctggtcctcagcagtcccaatgagccttctcggacgcccagcaacactgaggccattagtgtctcaccaccgagaattaggtttgttatacaaagaaccttgtcagcatgtgagagggtgacattgaaagtgtctgaggagcacaaaacaccacagaatggcttcttttggaatatgaacatgcccattaggtagccttctaactgctctcaactttcaagatctagtaacatagtggcaaagcataggccttcacaaacttaaaatatgagttgggcctcctgacccaggaaaacctgtctgtcactgctttggggtcttacgaagctcctggagggacttgccaagcagcgagaagttcctgccttctctgtggggcactgtgatcatgtgactgtcatccactggagaccatccttgtaccaacttccaccctcgtcttccattacaaagagaacctggtatcttaagttttctctattcctcagaaaaggaaaaaggaaagaaaaaaaaaaaaaactttgctcaactctgcttcccaatccagctcctgatttctttcctcccctttgttgctaatactgggaagaattctctacactgggcgtgcttcacttcctcacttcccactcattccacaactctctggaatctgccttttaccctccctgcaacattctcttgaagttcaccagtgatctccttaatgtgtagtataatgaccctatggaaatgtctgtgggattgacactgctaactggccctctcctggaagcccctttctccctggctttggcagcaccaccctctccgggttcttctcctcccttcctgaccactcctacaggtctcatttccaagcattctttttcctctcttgatcctgaaatatacacttccctgaaggtgctgcctttggctttctgatttttcttctcactctgagccacctcatccacttcttcagctgcaactatcacctctgtgccaaagaccctcaagtctgtggctcgtgttctagctctggccttgctcttgaactccagacccagacttccaattgtctgctggatgtccccacatgaactccagcccctaactcaggatgccgagaatcactcaaacccccatgcccatctcacccccatttccacccaagccactcttctttccatgttctaattattatcctaggtcagtcacaagctagaagccccaattatcatcaatgcctcctttaccaaatcctggtgaccagtaaccaacgtctcctgagctcctgttcagggccaggatctagctaagtggtttgcaggcatgatttcatcatctcagcaaacctgtgaggtaggcattcatttcccctccatttcatagatgagaaactgaggctagggattaaatcacatgtccacagtcacacagctagcatgtgaccaatccaggacctggacagaactctgtctgactcctaagcactaaactctgctctgaatgtatttttttcctcatatctctcaagcaagtctcttcttcaccagaaaggagtgtgaggcagtaaaaaggagcatagactttgagtcagatggatctgagtttgaatcccagcttactaaccatggagactggggcccagtcatctgccccctttgagctttagtgtcttcctcagcaagtggaggtagtatccatcttgccgggttgtggagaggattcgaggtgatgaccctgtcccaacgtagacgcccaataaatggtggcccgcattatcgggatcatccatccccgctgcttctgactgctcagatcattgccacagctccttgactgacctcattacctcttgtctttttcctccttcactcattcttcttactagtcccagagggatctttccagacaaatcagatcatatcatttccttgctcaaaagcattcaggggtttccaattaccaattgattgagactgaaaacatctggccccaaaccactgtccagtgtcattatgcacatgtacacatgtgtgcacacacccacacagagacatctttgtagatgtaacgcccccaggttgcactgcaatgtatacaccgccctttctcagcctctcccctatatactctgattgcccctctcctacacacacatacttgacctcctctaccatggaaacctcgctggtcctctccactccctaccatcccagggaaacaaatcactccctcttcagctcctccccaacatttcacataaacttcactcatttccaggcacttatgactttgcctcacatggcagctatttataggcaggccatgaccctgtggtctcatgcaccctctatttctacctctcattgctgcctttgccccgtgggatcctaattgctcgtttatgtgttgtctactccactagcaaaagctgtgcaagggcaggggctgtttctgcctcaatgtctagaagagctgtgcctagaactccctgacacttgacgaatgaatgaactttcaattcctctccattccctgagagcaatgtcatgcacgtgtgcacacaatgccaggttcgtctttgtgtcttcacagcatctaacacaagtcatggcccaaaatagatgcccagtacatatttcttgaattgctaaattgcatttcttcctgttcatttagaattccattggaaagccaaccccctccctcttttcaaattctgtccattgcaggtaaagagcaaaatggggagggcttgttgactgagccccacagaatgtctacaggatggtgattggttcccatggctgggactccccacatgtgattgcaatgtctgccccccaccttcctcaatgggtaacacacccaggatcctcacaaatactttcaaagccagctcctgactaccccagcaattcgcttctgggattctctgacttgtttggccttttgtgctaaagactaaacagaggttttcattagaaaggtacaaaaaagtctgagcagccacccaccctcaacagaccatcagtttcctggggcagaggccccagcttatttatctccatatttcatgcacctaagtgcaatcagcaggtgctcactagatggtgatctacacggcatgtagatcaagatggtggacaggaaaacgctgccaaatgacttgatcctgcttctcctatgacggaaacatttggaaactcaggaatcagatttttttcctattcatgccacaaaccaccatacctgcagctacacacagcaccagcctcacatttgaatttgccattaaatttgccagtagctttgaaaaatatctcttgacccagtccatttctgtctccttctgtaatgcagctaatgcgacctcatttcttcctgctaaaatagcaacctaaaagcactaagagttaattccacataattcatttcttcaatacttcagatttttgctatgtttctaaaagctacaatttcatccaatttaaaaattcttccagccgtaatttggcccttctcttcccacgtctaacttattcacaggccatgtaacccaaaaaatcatctcttagggaacattataagaattaagaaacagtcaagagtaaaacttcaagtgttcaggctgaacgccttgctcaggtttacacgatgggtacacgagatagggggaaccgaacagatggagagatgagaagaacaggaagtgtggggccctgggcccacaacggcaggaggaaaccatctcccctcccctcaaatacttttctttgcagaaaatgagaattttttttaaaaaaaaacctcaccttctatacatggtaaagagcctgcaaattcacctctctagaaacacagtgttaggcagaccaagcaccaggtggcggagagaaatggctggcattgtgggataatctttcagtttctagaggaggtctgaggcatgataactaaaattacagagctgctttcaggtcagaaaatgaagtacaaagtgtgtggtttttttttttttttttttctttttgagacagagtcttgctctgttgcccaggctggagtgcaatggcgcaatctcggctcactgcaacctccgcctcctgggttcaagcaattctcgtggctcagcctcccaagtagctgagattacaggcatgcaccaccatgcctggctaatttttgtctttatggtagagatcaggttttgccatgttggccaggctggtctcaaactcctgaccttaggtgatccacccgcctcagcctcccaaagtgctgggattataagcgtgagccatggcacccggcctcaacgtgtggttcttacggtgacaaggtagtttccaaatggcctcttttacccctttctgtgtgacatttgctaccctggccaaacaccacattcccatgtgacgggagaaaggaattccaatgccatgaattcagaagcgatggatggagtgcagtgtgctcttgtgtttttacgtggctacgaggcgctgctgctgggtttcctagttcttttgacctagattttctgcttcctcccttgccccctcagcacacacatacccacatgtccttagtgacaccagcagtcacatttgatgttagaaactataaagttttctgttctcagcaatctcaaactcaaatatgggacacacttttattccttcagaataaatgactaaattcaaaacatacacacataatgctttaaagaacgtataaacccttccatgtcctattcagagctggaggcctccctcataagaataccacatttgatggaattgtattttttgaaaagagtctacactttctgaaggactttcaggtaccagggctcatttgatcctcacatcagctctgtgaggtgctaggtggctattattatctccatttttcaaatggctgattgacttggccaagatcacatatctagtgatggagccaagctagaaaccaggtcttctcgttcccaactcacaacactgtccccttccttccaccttggagtgatgttagaaataggtcatcatctccactcaagcacttagttctttccattatcttcccatcttcttttctgggagaaagaagcccaagggccctgtgacttcaactccacccactttctgatgactctgaaaccccaagccccaaccttagcctctctcctgggtccagactgacatatccagctgctccctgagcttttcttcttagttgaagaattcaactcacagtcacccgcatgcaatctgaagcccatgagccctttctcagccctgcctcctctcatgtatcttctatttctgtaaagccgtcaccacctactcagtctcccaagccagaaatccagtggcatcccagagtcctcctctcccttagcttccaagattggtcaagaaatcctgcctgtttgcttcctgaatttctctaaaatatatcctcacctcctcttagcctaggccctatcatctcttgactggaggcctgcgctcatcttcctgcagtttttctgccgactttagccttgcaatctatcttcacattctgatctctgatacagagctctgtcgctctctcgctctctcttaattagagacagagtctctctctgttgtccaggctgtagtacagtggtacaatcagagctcactacagcctttaactcctgggctcacaccctcctcccgcttcagcctcctgagtagctgggactacaggtgcgcttccaccacgccttgctaagttttatttttattttcatagagacaaggtctcgctttgttgcccaggctggtctcaaactcctgggctcaagcgatcgtccacttgggcctcccaaagtgctgggattacaggcatgagccatcgcacccagccagagctctttctgaactctaattcttactgttacttccctgctcaaaatcctttaagggctccccctacatttcaagatattcacagtctacattccagccacctggaggcatttcattcccagaacacaccacacctcctcagagctgaaggaggaagtccattgccatctgacttggcctcagtaactcctttcgttgccaaggcaagtggtctctcctctacatatggatgccttttctatctatttctgctttcttctttatcatcacacttctatcagttaagatattttcaggagcaagaaacataaactaaaaatggcttaaacaataacaaagacttgtaatttctcaaagtccagaagtaggaaggctcctgggtatcatctaattcagcggttcagtgacattatcagagttctttccatcttttgctctgctatccttatttagaattattgttctagtctatatcaaagacttaaaaaaaattttttttttgagagaggcttgctctgttgcccaggctggagtccagtggcaagatcacggttcactgcaaccttgcctcctgggttcaagcaattctcctgcctcagcctcccgagtagctgggattacaggcatgtgccaccaggcccggctcctttttgtatttttagtagagatggcatttcaccatgatggacaggctggtctcgaactcctggcctcaagtgatctatgtgccttggcctctcaaagtgctgggattacaggcgcgagccaccacacctggcctcagactttcaaaacattctcagtggcggtgtcaaatattttgtcttttaatggtgaatctcattttttgagaaaccagaagccacatacagtcaagtctggtgagtaatatgagtaactgaggtagacaataacatttggggtcacagtcaaagtcaggccacagagtaacaagacagaacttttggttttgtttgggatctggctttaaaagcaagtttagaaaaggcatcccaagtatcttgggttccagccaaatatctgtgaaatacacagcatgtgaacacaaagagttactgtttccaaagctggccccactgggatgtttaagttttaatctgcctgtttaaaaaacaataacaaattgaatttttgaaaagtttcctgggcctggtggctcacgcctgtaatcccagcactttgggaggccaaggcaggtggatcactaggtcaaaggatcaagacagtcccggccaatatggtaaaaccccgtctctcctaaaaatatgaaaaattagccaggtgtagtggcgcatgcctgtaatcccagctactcaggaggctgaggcagggggatcgcttgaacccaggaggtggaggttgcagtgagctgagatcccgccactgcactccagcctggcgacagagcaagactctgtctcaaaaaaacgaaaaacaacaacaaaaaaaagagaaaagtttcctggttacctggaagagaaaaaaaaaaatacaccgtggagtaaccattcttccttctcaccatctgctgagatgaggaacttaaggtgctaactgggacaaatgaatttccaaaatagaaaaagggattcagggaagtccttgagtgctgaatttgggaggccaagccacagtggggtgacatgagtggacggcacaagtggacagaaataacctggggtcaggagaagctgactccaaaggtaaacccacggctcctccacaggcctggggtaaatcctagaacagctgttgagttctttcaacttattaacatattttcctctaagtccaaaagggccttctttgcctggcagcccctttctcttgtttttttggtgtcctccctccaatgtctttgtctttccttttcttccatgtagattttaagtaaccaagaggagtggtttaaggcggagcttgggagccaggaaggatatgtgcccaagaatttcatagacatccagtttcccaagtaagtatctgcagcctgctgagatgggcctagccacacacactcctcttacatttccagcagtcactacagttatccatgggaacccaagacattgtcaaaaatggctgcctctggagctctctccggagagcctccagagcatgcagctgaaggccagggcaggagggagactttgcatttcatttcattcccttttgatgtttacaccatgtgcatgtattgctattttaagttgttcttaactttttttttttttttttgggagttggggtctccctctgtcacccaggctggagtgcggtgactccatcaccactcactgcagcctaaaactcctgggctcaagccatcctctcacctcagcctcccaagtagctgggattacaggcacatgccaccacgccaggctagtttttgtatttttagtagagacagggttttaccatgttggccaggctggtcccaaactcctgacctcaagtgatctgccgcctcagcctcccaaagtgctgggattacaggcgtgaaccaccatgcctggcctattttaagttttgggtttttttgggtttttttattcatgtgtttatttgttttgagacagaaccttgctctgttgcccaggctggagtgcagtggcatgatctcggctcattgcaattctcctgcctcagcctccctagtagctgggattacaggtgcatgccaccacacccagctaacttttgtatttttagtagagatggggtttcaccatgatggacaggctggtctcaaactcttgacctcaggtgatccacccgcctcggcctcccaaagtgctgggattacaggtgtgagccactgcacccggcctattttaagtttttataaaatgagtttgtaaactcaaattatctatagtgatttcaatcacggcgttccccagaattccaaaggggacgctattggccaccccacttcgggagctgctctcctaagcgcttctctgtgacctcctaatcctaaccatcctcaccaggctctcacccttcactcagtgggtggacagacactccctgccttcagtaaagcatgctcaccccaatgagagaagtcagcggggggaaggggaaattctcttcctaaagaggaaatgaaaaattgagattgggcttcgtttgtctcaagaattgaccacaagggttagatagaaatctaatcttgcctcagaaccagggtctagctcaaagagcaaaagcttgttagaaaaccacagtagtattggtgactccagcaaggtgcaagagcaccagtcttggtaaacctgaactgaccaccaaaccaagagaatgaccactgaccttgacggaacccttgatgctgcccaggaatctgctaggtgacctctgcataccccacgtgctcctcaaaccttcagcccctccgtgcatcactcttagcccgtgaccttgattccaggttctctggaacaatgaaagccaccagaagtgaagctcccagacccccctcccccaccgcatccacctgcctcctgcaagtgtgctcaaacagtcggcctttcctgcagctggctggaaggaactgtcactgcttctagcagaaattctcctctctctctcttccacgtcaacctcctttccctctctgctggatcattcctgtcagcaaacacacacgctgcaatttctcccaacttaccaaaacacaaacaaacaaaaccaaacccagaggccaggtgggttttgttgtggctgatgcctgtaatcccagtcctttgagaggctgagggaggaggatcacttgtggctaggagtttgagaccagcctgggcaacatagcgagccccatctctacaaaaaatttttaaaaattagctggtcgtggtggcatgcgcctatagtcccagctgcttgggaggctgaggcaggaggatcgcttgagcctgggagttcaaggctgtggtggaccatgattatatcactgcactccagcctgggcagcagagagagactctgtttcaaagaaaaaaaaaatttaaataaataaataaatcaagaaaattcttaatcccaaatccccttccacttgccactccatctcttcaaaaggagtgtgtgcatttgctacttccaactcctcatctcccgacccttcccaccaggctccccatgggctgtagctcccaggggtcatctcagcatgacctgccctggggatcccccctcccactggaacacctctttcattttggctccaggacgtccttcctccggttgtcctcccactgccctggcttctcctcctcagtctcttgtgttggttcctcccactccccagtcccctataggtttagaatgtctccttttcagtgaggtctttctcatcaccataccttacattaatctcccacccacagcgccccatctctcctctcagttttcatgttctccacagcacttaccatcatctggcacgcttcagatcttaattattttgttcttttgtgtgtgtccccctcgactagaatgtaagctccctgagggcaggggtgtgtgtctgttctgcccactactgtgtccccagtgcccaggaggggcccagcacagtactagatgttcagtaaagctgttgaatgaatgaatgaatgaatgaacgaacgaatatgtattattgaaaccatgaccactcatgtctaatatgcaatgtgtggtgatttttacaaatctttaaagaagccccctatcagattgcagtcagaggacaaatgtgtatttcctaaatccccttcacttctgaaatgtttcctttgcgatatggctgctgtggtgcatactccattcctcttcccatccccattacatttcccacacgtggcagtggtgtgtgtggtggcctcttgtttagccctgtagaattgtgtggcaaatactcaggcagaatctccaggccaccagaaactgctgctttcagccctctcagagcacagccaaacttccccctcagtcccagtgggggactcagtctccagtaagtacatccttcctgctacctatgtctcagtttcccaaattctagaaagcacagagaattgctcacaaaggaatccaaagccaaggcctgacgggcttttatcttaaaggaacatgcgtatgagccttctggtgacagcaattagagcagccaccttgaagcaatgtgacacagtcccacctttggccgctgagtgattgcagacactcattttgcttgtctgtggtggagagaggtctctggcctcctgctttgaggctgcagccacagcttgcctggccctgtgtaagtgtttgacctatttcatacatgccacgctgtatgcagctgtacctccaggggctgccaccctgaccattctgctaaaagagtaatttctcctgtttcttcttttccacagtaaagattatttcccagcctggatttttggggcaggcccaggatctggttgtatagacgccgctctctggcggctgccagcctcgctgatttccaagcatgtacactggactccctaggaacactgcagcctctgctaggcacactgagcaaagcccccttgtgctccatgccagcctaggtaacgtgacgccctgggctgtaactttcctttaatacccagggaggaacctctaggccactgagacctcagggcaggcatgagcaccccaggccctgctcagccggctgcacctggttggctccagtgcctgaagccttcccttccctccccagtgcatcctctgtcctcgcagctctggtctatctcttccgcagctgccggcaggcggctgcttcctgcagtgagtcactcccacactgccccattttggtgcagcgacacatttccatgattcgtttcccaggctggagagagacttctcctggagagaaggaacaaagagggtgaatcaaggggaatgctccctcgcctttcctgaaagctgcctggagcactggtttgatttcaaacagcacctggtctctctctgctccctactgtacagagtccccagcctctttccctctgggtcacctcttctccacgtctccctcttgtcactcctgtgtctcatcctgatccttttgtttgatctcgcccccacagatggtttcacgaaggcctctctcgacaccaggcagagaacttactcatgggcaaggaggttggcttcttcatcatccgggccagccagagctccccaggggacttctccatctctgtcaggtactgaccattcctgacactgccttggcccttctcggcctgttaacctcacagaatgctgaagccatgaagggacctctggaatatgacccaatggtcagaagcatggtggcctaggggccaagcatggcagcagcttcacaacctgctgctcccagtgccttcccaaaacatgcacacaccactctttagaacactggtgtgtgtttgaaattatttctacgcccatctgcctccccttctagcccaggtgcttctggaagggcaggattttcctctacttcatctttatgcctttaacagtgtcttgcataaaagagagacactcagtgagtatttgtggaaggaaggagggataggaggaggagaactcccacttgtccagatccatctgggggtttaaatcttaaccttttcttttatgattgatgcatatctgaagaagagtcagagaaaaatagaaatctcaagtcactgctgtaggatatacaggggcggaaaagttgtggcacctttctttgcccatcagaggagtcacagctgacactcctacaagacaggttaacaagaggagagtggacacatttatttaatcaaagacttgtgtgacacagaagccttcagaaatgaagacccaagacccagggaaagccgtctatttttatgcttaggtttgtcaaaggacagacagccctgtagaaatgggattggacaaagggggtttgatctaaggtaacagactgaggtaggaaactgaacaaggcctgtcccaagtcttcttttttttttttttttttggagacagctgttgcccaggctggagtgcagtgacgcaatcattgctcaccacagcctctgtgtcccaggctcaagccatcttcccacctcagcctctcaagtagctggggatacaggtgcacaccaccacacctggctaatatttttttaacttatttctttgtagagactaggtcttactgtgttgcctgggctgatctcaaactcctggcctcgagtaatcctcctgccttggcctcccccatagtgacccttctagtctctctgacccactgtggggaagaggaattctaatttctatgactcactcagggggagaaagaggagcgggagacaggagggcaggagaaggccaaaggaagactttgcttccaaggctgcttctgaaaccttcccatctcctttggttcgaagcactcagcatgccaaggggtgtcgttttctgagccccaacaaatacatgtatagttgtaggcagctgaacaaaaagaaaggctacttcaacacagtacagtacagcaagaccgaaaaccacagaacagagggccaggagtgggggaggactgtaacagcgaaatctcactaaggtgcagcaacccataggaagtgactcagtccacgcgtagacattacacagccccaaactcagaagcccagttcggaacacactgtgtgtggtcagcatgttgaggatcgcaagtcacgtatcagacttcaccacatgtgaaactgcaagaatataatgctgttagcagatcaggagaagtacagcaaaaccttactgtcaagttattggcaggaaataccgatctggtttattcaatatattttgaaaggcataaagctttgttttaaggacagaaatccaatctcaagtaataaactgtggccactttgctgtttagaaagaatggatatttgaaaggataggtaggaaggacttaaaaataacaggtcaacaatttgtatgcatacatacctttaaagtggtctctttagcattgcccttgcaatcttgcttaaactcttttcttcagtaaaaactttattttcatagcttggagaatggttaactttagttcaggccaatattgatgtatcacaaattctaatcttgttaggtcttaattaatgaaatttcgctccattaacatatattacaagtcagggtcgggcgccgtggctcatgcctctaatcccagcactttgggaggctgagttgggaggaatgctttaagccaaggagttggagaccagccggggcaactagtgagacctcatctctactaaaaataaaaaattaacccagtgcagtggcgcatgcctgtggtcccaactacttgggaggctgaagttaaaggattgttggagctgggcggttgaggttgcagtgagccaagatcgatcgcaccactgcactctagcctgggtgacagagcaagaccctgtctcaagagaaaaaaattatttacatatattatatacatatattattagaaaaaacaattatacatatatttaacatgcgtgtatatatattacaagtcaaatctatttcttaagcctcccctctttaccccatcataaacttgaccaagtaatttgttagactgaggggtatctcttgggcctttggtttgcatgaagatgactctggctttttcagctagaaactatggtttttgtggtttcgttggttttttgagacagactctcgctctgtcgcccaggctggagtgcagtggcgcaatctcggctccctgcaacctccgcctcccaggttcaaagcaattctcgtgccttggcctcctgagtagctgggaccatgggttcgcaccaccacgcctggctaatttgtgtgtgtgtggtttttttcagtagagacggggtttcgtcatgttggccaggctggtcttgaactcctggcctcatgtaatccacccgcctcagcctcccaaagtgctaggattacaggcgcgacccactgtgcccggacccagaactatggtttatatttccttaattaaagtgagttctacaaaacagtaggccttgacttctaccgaagtcttcccctgatattcaggcgatgaagcttctagttatggtgacaattaccgtaatccttatcacgtctttgcagaaatgtagtataatattttccaaagcaaaatcattattaattatttttacatctgtcatgggcacagataattaagagctaattgtagttctatcactcagcatttgttaagggcctgaaacaccagattttggagtccagcgccctgagtcgcatcctttcctttgttcctcttcaggcttgagacaatggtcaggccatcctctccttgtagacccagataaccagctgcaaccctcacacccatccttacagcttatgagagtaaaagggtcaatgtttcacactctgagttctttgaggtggtggatgaaaaattataatatcacaagaatattttctcctcctcacctggatgtgaaggataatgactttgagttgatccatgttgtcttagaatgaagaaagtatctgttggtggccaaaaccaaggggaagaccacaaagtgattgcaatatgttgattaccacccgaaatcagtcaagcaagaggccacttgtacaacctgtggcttcacccagctatgagcaaatcccagcacataagatgagattgagggtcagaatttccatctccttcttaacacaggtccctaaatccatccctaagaaacctccatggtcaggcgcagtggctcacgcctgtaatcccagcactttgggaggctgaggtgggcggatcatgaggtcaggagatcgagaccatcctgtctaacacgatgaaaccccgtctctactaaaaatacaaaacttagccgggcgtggtggcgggcgcctgtagtcccagctacttgggaggctgaggcaggagaatggcatgaacctgggaggtggtgcttgcagtgagcagagatcacgccactgcactccagcctgggcgacagagcgagactctgactcaaaaagaaacctccacttactctcagaggtatctttactctccgagaccctttaaaattcttgacctttcttttacatcaggcaattggcatcactagtgccagtttatttttagatataaatgtatgtctgtttgaaaaataaactttacatccaaaagagaatgacttggcaatgaagtaaaactggatctaatggtaaaggctcagcccacccttcctagatggataaaatccattttctctagccctggttcgaatgtgtcccatcacttgtgagtccagactggcaacaaaaggtgctgatctaaaagaagttatcgtccagtggcagggtctggggaaggggcggcaggcgccatgtccagccacgaaggtggcaagaagaaggcactgaaacagcccaagaagcaggccaaggagatggacgaggaagagaaggctttcaagcagaaacaaaaagaggagcagaagaaactcgaggtgctaaaagcgaaggtcgtggggaaggggcctctggccacaggtggaattaagaaatctggcaaaaaataagctgttccttgtgcctaaggagacggtgaccctttatttcatccgtatttaaacctctctattccctcctataatatcttttgccacctatagttggaattaagtgtcgtcttggagctgttgtacatttaagaataaacttttgtaaaaaaaaaaaaaaaaaaatcttccagtggctcatcatctctttagttgttttcactaagtcattcctaccataactgtgaatttaaagtaaaaccagctcagaatcttgccagaatctgctctttggtcgttgttctaccctaaactttgtatcacctgaaattaaaccaactcatttgaaagaaaaaagaagttatcatgtttaggtggcgtgacaggccaagctcactagactggagtcagagactcagggttctggcctcagcccttactcagcagtgaccttgaccaagcccctgcacctctgtgagcctcagtgtcctcatctgtaaaatggagaagtaaggctaaacaatctccaacatccttgccaattaaaactctatcatttcacagggcgcagtgcctcacacctgtaatcccagcactttgggaggccaaggcaggtggatcaccggaggtctggacttcaagaccagcctgaccaacatggcgaaaccccgtctttactaaagacttggtggtgggtgcctgtaatcccagctcctcaggaggctgagacaggagaatcgcttgaacctgggaggcggaggttgcagtgagcagagatcacaccactgcactccagcctgggcgacagagtgagactccatctcaaaaaaacaaaacaaacaaacaaacaaaaactctgtatttcatacaaagctatttcaccaaaagctgaaaacactttgtaaccttatttatgcaaaacataaaccaagatcaagagatccttattacatagagaaaaaatgtgacatatttcttaggaaagagagtagcttcttacctgccagtgctagcttatgggcttaaaggagatggttcaaagaatttctggtaacagaaagataataggagcttgaaatacccctgttgacatcttgcgaataaacattgtgaaaaggtctttgatctctttgtcgttaagtcacttggaacatgcttttcttgtaaaaggttagttccagtgtccaaaacaaattttagctcatctgattaccttctgctgatgtaaatcccgtctagcatagcctgtatcctaagtggtccatcctacaaagttcctgccgaagcctgactgggctggcccacctgcccagtgatgagtgagtcatccatatctacatctcctgctcaaagagaactccaccatcccagatgtgagcagcctggaggtggtgacattatcaccgtgtaacatacaattttgttttgccttgatctccaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccaggtatgctccagatccagtcgaccccaatctagagattttaggcagcctgagttctcacatgaaccaccaggaaaaatgcataggatgggtagatcctctgagtatactgaaagacagagctcagagctctgaggtcagatctcaacttaacacttcctagtcgtgtgactttggaaagttctctgcgcctcagtttcctcatccataaagtagggacaatggtaatatctacctcccagaatggctgtgaaggttggagaagataatgtatcccacgcctcatgtcattcctcatcacactgcgctcagcaagcatcagctcttaccacaggtgctgtttttttgttattcatagacattgctacaccaaagttttcaacctagctcaagagttgcccaaggatgaaggagttgggggtgctacagacagggacattagggaacagcctagagttcaggagttaaatcagcatgtggagttttatgatgggattgggggtagggaggacatgggaggagaaaactgcacttggaattattgctgttgcaactgtttgcaatacagactattgctttaaaaggaaatgcgtcagacagacctggtatgaaatcctgctttaatcgcttagctacctgtattacctagccaagttaagaaaccatctgagtatcagttttctcatctgtagaatggagagagcaataaaacctccctcactgggctgttgtgaggattaaatgacttaatacagctaagcactaccagagtctggtccatattaaacactaagaacatgttaacttgcctcccataagtaaattcacacatgcacacactcacacacacacacacacaccaatttatgaactatttttcaaaggaaataacatggttataagagacaggtatcataggaagaagcattcactagaatagctgaaatcctagggacaggttatttgaaaagatattgagactgtgaaagcaatgtgtgctttggggaagtcaagaaaatcctcctttttcgagtccctagttgcttttaagcctgagaagttactgccaaaggagaaaagaagttaccaccaaatgcacacagaagttcagaaaggaaaacaaaggctagccaagaccttgtgaatcactctaaccaggaaacggacagaggtattaactcactaggatgggcattcagagaagcaatataaaattgcattaaatgggattaaatgagttgatatttgtaaagcgcttagaacagtgcctggtatatgctgccctcagggtcctacataattgtttgttaaatgaaactaacaatacggtatttctgatttgtaaggttgttgtaacattagggaaaaaggccttacttcttcccccacgtccagcccggcggcaggcctggttcccatggtgttgcaagaatgttgctgtttgggtctctatcaccaggctgtaaatgacagttcaaaatcatgcaaagtcaacagtggagcttatctggagggtagattgtccagtggtgtggcaacatgtgataagaaggggtggcattgtatcagtaaaatggaatatttcagcttgattacacagagaaaaaacgagcgccctggaaatggactaaatggctaccaggcaaaaagtgttagtctgtgaaccagagacctgcactcctaaaactgggaggatctgagaatgcagaggccactttggaaaatgtgaaggtctaaagcatcaattatcttttagctgcccccaccccaccagctatttcttggagccagatgagcagggtctgggaacaactgcccgagggtagggtagggccagacgatcagagaggaggatgcatctgcagcatctctgttctttctcccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggtatctggaaagaaggcagtgggcacagtacggtggaaaggagaacctgcctcccctccaggcctggcccagcctcttgagttctcagagagttcatgatgaagaccctggacccccccaaatggcagaaatagggaaactgttcttggcaaagacatctctatgaattaaatggctcccacctgaacacacacacacacacacacactgtctcacacacacacacacacttaaactcacacacacacacacttcccctgaggacccagtaaacaattgcttcattttcctatcagcacaattccaaatctattcatgccccttagcccatctggctgtcagatccacaagagaaaaaggcttaatacccacaacagagccttgtttattacttatttatctccctccacccttgttcccgatgggatttcaggcggcttactgagatggacaatacggccagataacatcattcctgaattccttagcagggcacacaaagtcctttgtgagctgccagaatctatttccccagcctcgtccctgctgcctccctgccaactccccgtgcaaacacacattccagcaaccccccacgctgccttagttacccgaatggtccattgcgtttcctctcatgcctttgtggcgttttatatgctgatctctctgcctgatgagcccctccctgggcagtcctacccctctaagctggagttcaagcatgacctcctctgtgaagccttccttgatttcccgggcagatacagacatttcttctctctgctcacttaccacttaaatgtgcatggttccccctctaaatggaagctccatgaagccagagaccttctctttccagctatatttcccttgtgtctgctactggaaacatggtaggtgcctgataaatatttcttgactgaataaataaaacctgcctttgccttctttgccttcagaatctaaggtgcctttagaccttaggtcctcctcaacgtggagggtttattgtcattatcagtaagtattcctggaatataccggctctgtggatggcatctgagcaaggcactgggggaaccggtgggagatgtcctggcagtggggtgaccagtcttctgttgtatgtttctaggaacgccgaggaggcagccttgacataaatgatgggcattgtggcaccggcttgggcagtgaaatgaatgcggccctcatgcatcggagacacacagacccagtgcagctccaggcggcaggggtatgggaactgtccttctctgggatccctggggaaaggccttgggacagaggtcaatggaggagatgaggcaggagagactcaaaccacacagatctggctgggcacggtggctcacacctgtaatcccaacactttgggaggccaaggcaggtggatcacctgaggtcaggagttcgagaccagcctggccaacatggtgaaacctcacgtctactaaaaatacaaaaattagccaggcatggtggcagatgccagtaatcccagctacttgggaggctgaggcaggagaattgcttgaacccaggaggcagaggttgcagtgagccgagattgcgccattttactccatcctgggcaacaagagcgaaactccgtctcaaaaaacaaaacaaaacaaaacaaaaatgcacacacagatcaacgagaggtgatggaatgtttggggaggcctggggctgagccagcaccgtccagtctgttgatctcagtctggtgccaggccttccctgttctcatagttctcagttctagttctttatcatctttatcatagtcctttaccattgcctttatcattgcatcttttttttgttttttgagacagggtctcactctgtctcccaggctcaagtgcagtggcacaatcatggctcactgcagattcaaactcctaggctcaagcgatcctcctgcctctgcttcccaagtagctaggtatattatttgtagcgataagctcttgctatattgcccaggctggtctggaactcctgggctcaagcaatcctcctacctcagcctcccacagtgctgggattacaggcatgagccaccgtgcctggcctgtgatccatcttgacttgtgacttgattgccctaacaccaagggctgttgtttggggcatgttgcccttctgtttgtcactcaagataaaaataccacctattgatgtggagagagtggttctcagggagtctattggggctttggacaataacatctgttggtaaaagtcctgggtctccagagtgacgctggtgcgttctgggaacttcttgctcaggcctgtgcataggtatctgatttaaattgcagcagggtagccgggcatggtggctcacacctgtagttccagctacttgggaggccaaggcaggaggacttcttgaggccaagggttcaaaaccagcctgagcaacatagcaagaccccatctctacaaaaaaagtttttttaagctgcagaggggtcagccttcagggaatgttgctctcaaagacttggatgtggtgggaggagccagcagaccctcccctgcctgcccagcccacagctcagcagagcctcttctgtgcttcccccaacagcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggc

SEQ ID NO: 1738 - DNA, 3313 bp, Homo sapiens
  source 1..3313: mol_type = genomic DNA
acgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggaggtgagagtaggtccggctcggacaagggtgggggtcgtctgaggggagcttgacccctacgtcttatttttggaaaaacatcctctgtcccactccttcaactcctgcagagaggacagaagtcgcaacattgaacactcaccccgccacagtaaccaaggcggtcattaagaggagaaacagcaaactaagcctttctccaacctggggtgatgcaacagggacccgggcggggaagaccgtgagggtctggggaataagacagtgagcaagtgagcaggaccttgggagagagaggagggactggggcacactgaagaaaaactgggggaaggtgtatgaagggagctgcgagctgaggtctgactttgattaaaaaaaaaaaaaaaaaaaaagaactgtcagccattgtattaatgttttgatgtggcagccagtcctccgaccctctccctagcttcccagaccccttgctcttgtcccactttgccacccatgagttgatttaatggcttaaatagtgctgaaatattggtggccaatctgcctccactctcagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctggtgtgtggctttccctaaggggcaacctgtggtttctggtgggttggtgggtgaaataaagagcctgcagggagtagctgggggatgggaagtgtgagaagactgatgatttcagagagattaatagagcccaagtcctttcccatcccagcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcatagggtgagtatcccatctggtcctgaagtgagagcttgtgagagaccactaataaagtgcaaagactggctaggtgcggtggctcacgcctgtaatcccagcactttgggaggccgaggtgggcagatcaccagaggtcaggagttggagaccagcctggtcaacatggtgaaaccccgtgtctactaaaaatacaaaaaattagccgggcatggtggcaggtgcctgtaatgccagctactcaggaggctgaggcaggagaattggttgaacccaggaggtggagactccatctcaaaaattgtttgagacccagccttgctctgttgcccaggctgtagtgccgtggcacaatctcagctcactgcaacctccaattcccaggttcaagtgattctcctgcctcagcctcctgagtagctgggattacagtcgcctgccaaacgcccagctaatttttgtgtttttagtagagatggcgtttcaccgtgttggccaggctgcttttgagctcctgacctcaggtgatccacccacctcggcctcccaaagtgctggaattacaagtgtgagccatcatgcctggccaaagattgcaattcttgtttgaatctgatagccttgggttggaatcctaagccctccatttagtgttttctgttttctatattaagcttgtgggattttctttggggggagatgggtgttctgtttcttttaaaaaacaaaaacaaaaaaacaccactggtctagataattcttggataaggcaggattgtgcacagaggataggaatatatcagttcaggaagtctttctggtagaaggatacataaaacagccaggaaggagtgtgtaaataaggctattctgaatggaattatctcttctgtggaagggggttttggagctcgggagtagtttgaggtctatgacctttcaaatttcagattggaaggagtcttttcacttactatggtttcttctgcagtttgatgatgtatggcctatggacccccatcctagaaccagagaggacaatggtaagtctggaggaaggggaagtttaccagccttttgttattcttctgaagttctgtgtgttctccctccctgaagtttcttcctgtacacttgtctccttttttcctttggactctttctctcctgcttcttcatctctctgctcttccagatcttgattcccaggtttcccaggagggtcttggcccggttctacagccccagcccaaatcctatttcaagagcatctctgtgaccaagatcactaaaccagatggggtgagttgaaagaaagaggtaaaggaaagtatggccagggaacgaatgccctgaaacagggatctgtgtaaagaaactgctgagcataacctttagtaacattcggaatatggtggggacttctctttgtagatagtggaggagcgccggactgtggtggacagtgagggccggacagagactacagtaacccgacacgaagcagatagcagtcctaggggtggtaagttaaaagacaaaggggttcatctcaagattccttggggaagggaaatcttactcttctacccttgtcctttgcttctgcctagtctctttcatttagcctatttacgtgtatgactttcttccttagatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgctaa

SEQ ID NO: 1739 - DNA, 3313 bp, Homo sapiens; identical to SEQ ID NO: 1738
  source 1..3313: mol_type = genomic DNA

SEQ ID NO: 1740 - DNA, 56283 bp, Homo sapiens
  source 1..56283: mol_type = genomic DNA
ggggatttggctagaaggctgggccggcagcggttgtgaggagttagctcgcggcattgcaggctctgagaggaggggacccggttcccgggtgagtgtccaggcatgccagcggaacggcccgcgggcagcggcggtgagtgaggaaaaccttttgggcgcgggtggcagcctgcggggctgaggtgggcaagcatggaggctgcggcggagtttcggggagggagccgaccccgggcagggactgaggaggaaaggagggttgggaaactgcaacggtgagtggaggacaccccggaatcgcacgtattagcatgccggtgaagatttcacataggcaactgcattttcccgagcatcccgagttgtaaactgtggtccaggcgacttgtagacattgtgaagacttacggtgtcttctgagaggtgatgctggcgtcccctcggtcttcagcttttgctccagtgcatctcgggtgggagaaaggctgtttcttgttggagttgagtagttggtaatttttttaaaactgcaatttgaaagctttctcccccgtcaggctcggaggctccagcaatggttgaacaactggacactgctgtgattaccccggccatgctagaagaggaagaacagcttgaagctgctggactagagagagagcggaagatgctggaaaaggtaatttaggcatcaggttcgtcgtcgtgaaagcctgtggtaacctcggctttaacccggaggtgtggtttgtgttctttgctttcctatttagtgggctttttaataactgaaagaaaacagctttattacttgtcttttttgtatgtttacagatattgcctttgagaatcctttcgcaagtgctttgaatggtgtgtttctatgagatgtagtcttggtagtcccatcacttttaaatgagcatttcagattgcttgtttagccatgaaaagtctttcaaagtccatagtgagttttttcgtttgtcatccttatttcctttaaaaattaccttaaatgtatgtctcatggcaaacaggaatcgctaaaacctgcagaagtaatgtactagactgagggcaggagaagttagcatcaatcaaaggctgggctggaatccaagtctaatgatttccttatactgtagtgctgttttccacctaagtgatcaacttgctgtttgtttttcttttggtttcatggcctgtgtattgctacataagattctttagctaaaaatgtgccgtactttttcaatgacaagttgctgtagttttcttgtagagagcattttgtaagttactaaaaacagtttttaacctgaaaaattcttgtttattctaaagccccaccctgctgcttgattcatatgcaagaaaaagaatgatcgttgactcttaagtactgcctagtacgtggttttcttgtgctttattaatttattaaactctaccgatattatgatataggttattttttgttattttcatttacaaatgaagaaactgagggagaagggcacatagtaagtgttgaagtcaaatttcaactcaggctgcctgcagaatttctgtccttaataatagtgaattaactcatgattataaaactacttaagttggaaaataatgcattccaaaaacgagtaatgaggccgttggttccctgttatgtcaacaataatttttttgtcagcattgttaatacttcttgaacatttattaggagtcatgcattgttttgaatgctttatatgtatttactcattgaatcctcaactattctgtaaagtagatgttcattattactattactgctattaaacttactagtttaattactagtataaacaattgctattattgaactacacaaccaaataggttttattagtcatcttattttacagatgaggaaactgaggcacatagaggttgtttgggtgccacagttggtaaatggcagagctaacattccagtgtaggccatgtggttctagaatgcacattttttaactaccatgctatagttccactccagtaatactccttccgttattactgatgatctctggttgactataaccagttaaggtaatatattaacaaattttctttaagtaacatcaatactttttgcttcagggtagatgtgaattaacagaattgagaggtctgacctgaaccaccttttctcattctttgaattttcatagtactttattacacagaatttaccatgaccaaataagtaatgataaatacttcatactactttttgattctttctcactttgtttcttgagggtgcatcacttgctgttttgtttttgtaggctttgcacctggcacatagtaggcaatcagtaagtgcttattgaatagctaacgatgataaaatggtattttataatatacaagattatatacatatactaaatatacttattagctatataaccagatgaattataaagtataaattctggggcaagtgcccagaatggaatcaactgaagaagtctaagagggatgtgataattttgtcttgagtaatgtatcttcagttttatcttgtttcttcatatacccattatgagtgttgggtagggaaatagcatttaaagaaagatatgcctgagatatgacaacagtacattttcagaaggtattattcattcaaggaagaaacacttcacatttaaaaaagataagtcaaatatgtagtattttatatatttgctgaggtcaaatgacctgctacttttaatgacatttttaagcttatgaacaaacattttgcagttagtcctaaatttaataattatgcatcatagaacctaaagagtaatttttaatccttccattaaaaaagtatatggctgttttcatggcctggcatggtggctcacgcttgtaatcccagcactttgggaggccgaggcgggtggatcacctgaggtcaggagttcgagaccagtttggccaacatggtgaaaccccgtctctactaaaaatataaaaattagccagatgtggtggcgcatacctgcagtcccaactactcaggaggctgaggcaggagaattgcttgaacccaggaggcagaggttgcagtgagccgagatggcatcactgcactccagcctgggtgacagagcaagattccgtctcaaaaaaaaaagtatgtagccgttttcaatcttaatataagtgtgtaatttgctaaaacattagtgttgtggtttcgtattacattgtcttgttatgtacagataaggaaagtttttgattattttttgcactggaccctcataaaaagtgattgcctagatgacactagaaaattctaagaaaagttttcagagtctctacctacttgagattaataaacatgtctttggaggccaaacaattaactatgcacaggtagagattccttttcttttgggagaatacagtctgtatgggcatgtatttagaagtacttaacagaggaagagctagcttaagttccttaatgagaagcatttggctttaggaaatcctaaggtttgtgaggaacctagaaaatgactttgacattcattggctacagttattttctttgacttttcacatgtatttccctttaaaagaagtcattgttagtctaggagatttgagtactgatagtgcctgtgaagtggaggagggggaatagttggagtcaggagatttcttggagaggtaaaaggatcatgatatgtgtaggctaaaatagaactcctcccaccccccaataaaaaatctgggattggtgttgggagagataatggggtagataatgaggaatttctgccctcggtgtccattggcatactctgtactgtagttacccagagttgtttcctgccaggcactcagtgcttttaatagatggagttgcaatttaccgtaatataatcatgaaattgataaataaagaaaaaacagtgataggaagatttgaaatacagaagaccaggtttaaggattaaccacttacatggtattattttaatattaattgtatattatttttttccatgatggcatcttaaagctttagtgatttttatttttatttttatttttttgagacagagtttcactcttgttgcccaggctagagtgcaatggcgcagtctcggctcactgcaacctctgcctccggggttcaagcaattctcctgcctcagcctcctgagtagttgggattacaggcatgtgccgccaagcctggctaattttgtatttttagtagagatggggtttctccatgttggtcaggctggtctcgaactcccaacctcaggtgatccgcccgtcttgacctcctaaagtgctgggattacaggcattagccaccatgcccagctgatttttttttttaggaaaaatttttccaggagcaccaggcaagtatttaggttttttttgcttgtttgtttgttttgagacggagtctccctctgtcacccaggctggagtgcagtggcgtgatcttggctcactgcgaccttcacctgccgggtttaagcgattcttctgcctcagcctcccaagtagctaggactacaggcgcgtgccaccacgcccagctaattttttttgtatttttagtaaagacggggtttcaacatattggccggcctggtctcaaactcctgacatcgtgatctgccttcctcgacctcccaaagtgccaggattacaggcgtgagccaccatgcctggctgtatttagttgttttaaaaatatgtgctggccaggcgcggtggctcatgcctgtaatcccagcactttgggaggctgaggcggggcagatcgcttgagcccaggggttaagaccagcctgggtaacagggtgaaaccccatctctacaaaaaattaaaaaactagccggcatggtggcacgcgcctatagtcctagctactcaagagggtgaggcaggaggattatcgcttgagcctgggaggcgcaggttgcattgagccgagatctcaccactgcactccagcctgggtgatagagcgagaccctgtctcagaaaaaagaaaaagtgctaattctgtacaggatttaaggtatcaactatatctaagttaaacccacgttattttaactgaacttaaattttaaaagttaaaaatttaagaatccatatattgtgtaagtaattttcatctccctgttttcatattcacctcagtagttgcgtattgtaaccacagtagtatactggtaatagtaaaagaaattctgtcctaaaagaactgaaaattgagttcaagatattaagaattatctgtgtaggtgggattatgggtgatttatatattttttgacatttagtttttctgtaatgagtatgcattacttttgttaggtccattcttagaatcttactgtagtcactgattttataatagaaatatattttgatgccgggtacggtggctcacacctataatcccagcactttgggaggctgaggcaggtggaccacgaggtcagttcaagagcagcctggccaagatggtgaaagcccgtctctactaaaaatacaaaaattagcggggtgtggtggcaggtgcctctagtcccagctatactggggaggctgaggcaggtaattgcttgaacccgggaggcggaggcagaggtgagccaggattgtgccactgcactccagcctgggcaacagagtgagactccatctcaaaaaagaaaaagaaatatattttgaaagaaagctatagtgatgatgtaatagctaggaaaatgtaaggcaatataaaatgatatcttagagatattgataagctggagcagcaaaactacccaagtgctagggcattatttagagtataaaaatgaattcatacccccatttcttttcttttttttttttgagatggagtctcgctctgttgcccaggctgaagtgcagtggcgcgatctcggctcactgcaagctctgccttccgggttcacgccattctcctgcctcagcctcccaagtagctgggactacaggcgcctgcaaccacacgcggctaattttttgtatttttagtagagacagggtttcaccgtgttagccaggacagtctcaatctcctgacctcgggatccgcccgcctcagcctcccaaagtgctgggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattctaaagttaacttaagtgtgatttttagtgctgttgctgaggccagtgttgcttaaagcaggaacttctacagtaattgacaaaacttgagtttttctgctctcatttatccatccttcagacccctcagatgtcatctatttcctgaaatctgacttctccagttttagtaattcttacaatttttcaggatttagatagtactgtacagtttactgctatgtatatgtctttaatacttgttgttttcagatattacactaatgtctcatctgtagtataaatcagactttctgtcttctaccagttacataatttatataattgttgcagtacatgtttgttgatttactaggctggattcatgttacagaattggtaatcttggttgggcatggtggcacatgcctgtaatcccagtactttgggaggacaaggcagacgaatctcttgagtttaggagttggagacctgccttagcaatatggtgaaaccctgtctttacaaaaaaaaaaaatacaaaaaattaacagggcatggtggcatctgcctagagtcccagctacttgggaggctgaggtgggagggtggtttgagcccgggatttggaggctgcagtaagccacaattgcaccaattacagcatgagaccatgccttaaaaaacggggtgggggtgttaatcttggctagatgtctgttttgattgttaggatgaattgtgttggtagtatttttctaaaatgttctatccaaatcaacttgtttattaatctcaaatagggagagactctgaaaacttgtcttagaattctctagtgtcacctaggcaatcactttttatgagggtcaagtgcaaaattaatcaaaaattttccttatctgtacataacaaggtaatataataacacggaaccacaacatcaatgttttagcaaattacacatacctttttttttttttccggacggagtctcactctgtcacccaggctggagtgcagtggtgccatctcagctcactgcaacctccgcttcccgggtttaagcaattctcctgcctcagcctcctgagtagctgggactacaggcatgcgccaccacgtcctgctaatttttatagttttagtagagatggggtttcaccattttggccaggatggtctcaaactcctgacctcaggtgatccaccctcctcggcctcccaaagtgctgggattacaggcgtgagccaccgtgcctggccccaatttttttttttttttttttggtacggagttttgctcttgtttggagtgcagtggcatgatctcggctcactgcagcctctgcctcccccgggttcaagcgattctcctgcctcagcctcccaagtagctgggattacaggcatgcaccaccacgcctggctaattttgtatttttagtagagatggggtttctccatgttggtccggctggtctcgaacccccgacctcaggtgatccgcctgctttggcctcccaaagtgctgggattacaggtgtgagtcaccgcacccggccttcaattgttttttaaatggaccttccaactcagtagtgccagaaaccatgtgttcaatatttgaaattataatattttgatatacgaattgcatctatcagattgcctgttaaacccaaaaactattttttttttaacagttatttgttccagtttttggtttgaaagtgtttggtttaaaaaatgttattttagccatttttattaaactttatgccaaaaaaattaaggtatgtcagaaagtgttcataattatggaaattttctctttggataggctcgcatgtcttgggatagagagtcgacagaaattcggtaccgtagacttcaacatttgcttgaaaaaagcaatatatactccaaatttttattgacgaaaatggaacagcaacaattagaggtatgtatatgtaactgactacaagtgaaagcttaaaaaaatttaaaaatagctttattgaagtgtatattatatacagtaaaatggacagattttaagtgtacggtttgctgagttttgactagtaaatatatagatctgtgtaaccaccagcacaatcaagatacagtgcacttccatgaactccaaaaaattgtcttgtgctgacagtaatccccatggctggtgtccagcaactactgatttgctttctgtcactatagaccagtattgttttttcctagaaaattgtataaatgaaatcatggtattgtgctagtgagtaaatagttggtcttcatcaccatttcctggtatacaactcttgaaatccttggaatcttcaaagtaatagtgtttttttttttgtttttttttttttaatgctaatgatcaatggctagctgcccttaggtagcttcaggatgggagcctaagaaagacaaaacctggattagagggttgggatttagcctcaccctcaactttgaggaaaagagactgaaagttaacttgttcaccagtggtcacgattgaatcaatcacgtctatgttatgaggtcttcattaaaaacccaaaagggctgggtgtggctcacatctgtaatcccagcactttggggagcctaggtgggtggattgcttgagcccagaagtttgagaccaggctgggtaatatggcaaaaccctatctctaatagaaaaattagctaggtaaggtggcatgtgcctctagtcccagctacttgggaggctgaggcaggaggttggcttgagccaaggagattgaggctgcagtgaactgtgatggcaccactgcattctagcctgggtgacagagcaagaccctgtctcaaaaataaaacaggctgggcgcagtggctcacgcctgtaatcccagcactttgggaggccaaggcagacagatcacttgagcccaggagttcgacaccagcctgagtaacatagtgaaaacccgtctctaccaaaaatataaaaattagccggtcatggtggtgtgtgcctgtaagcccagctactcagaaggctgaggcaggaggatcgcttgaacccaggaggcggaggttgcagtgagccgagattgcacccctggactccagcctggatgacagagtgagaccctgcctcaaaaataaataaataaaaaaaaccccaaaaggggacagggtttggagaacttctggatagctgaacacatggaggttcctggagaggatggcgcatccagaaaaggcatggaagctctgcgcttctttctccataccttgttctatacatctctttctctggtgttcctctgaatatgttgtaatctttctttctttctttcttttttttggagacagagtcttactctgttgcccaggctggtgtgcagtgcaccatctcagctcactgcaacctctgactcctgggttcaagcagccctcccacctcggcctcccgagtagctgggactacaggagcacaccattatgtctgtcttatttttgtattttttgtagagacagttttgccatgttgccgaggcttgtctggaactcctgggctcaagtgatctgcttaccctggcctcccaaagtgctgggattacaggggtgagccactgcgcctggactgtcatattctttataataaaccaataaactttaatgtttctttgagttctgtaagctcctctagcaaattagtcaaacccaaagaggggcttgtgggaaccctgatttatagctattcagtaagaagcacaggtaaggcgacttgggccttgcgattggcatctggaactggtagttaaaagtcttggggactgaaccctcaacctatggggtatggtgctttcaccccgtagatagtgtcagaattgaattacaatagaggacacccagctggtgtcactgcagaaatgcttgtttggtgtatagggaaaacccccacacattgggtcacagaagtcttttgtgttgattgttgagtgtgtagggagaaactgagtttgtttttttctcaatattcttgcacatatgcactctttgtcttgttacttttgctcagtgtatttttgagattcattcatgtcatgtttttctgtaggttattttttttattcctgagaaggattccattaagaaatgtcgttattggggtgtaattgacatacactaaactgcacatatttaaaatgtacaattccctaagtttgatatatggatatacttgtgaagacataacaatcatgatagtggacatacccactgattccaaaaaattctttctgcttatttataattcttctcgcccgtccctaccccatgttctatccacagatagccaattgatctgttttctgttattataggttcatttgcattttctgttggtgatgggttcttttagctttcatatgtctgaatgtcttcacttaccttcatttttgaaatacgtttttactgggtaaagaattttttttctttagtactttatttcttggagtactttaaagatgtttcactgtctcctagcttatgttgtttctgaaaagtgaaagtcctgataatgtctatatgtctgtaagcaatttgactgcctccctcaatcccattacctttcagacctgtctccagatgtgtttcctgtcttgggcttttgcccttgctattttatgcctggaaccttcttcctctaaataactgcatggcttaacttcatcttcaagccctgacttaaatggtttctagatgagacctgccctcacaattttaagaaagttgctaacacacctgattctctttaccttgttctgttcttcccattgcacttttcatctgatatacatcatttattgtatttattgtttgtctttccactagactgttatgaagatttaaaaacttgtgcaaattgagagaatacagtaagtcccggtgtccccatcacccacatttaaaaattatcaatttaaattttgctgtatttgtcaaatctcctttttcctttgtttgaaacccttttattacttttttatggtaaagtaaaacaaatggaaaaacaaatattcaacttaatgagttacacagcatctacccctttcatcacctcttggaaatggtttgaatttttggtgtctttaaaaaatttgtaagagtatgtctagaatagcttttagtctaggaataagttgatcccttttctgagcactctacttgatgccctttatattaagaggactttctactttggctgagagaatgtgaggtataccttattatgcctgaccccttggaacatgagaggttccacctgcttctttctggtgactcttctcctggccttggttaccatgcacttaccagtactcagcctgagagagagataacagctgcctttgtgcagctttgtcctctctggtacttgaccctgggaatgctactgctcttaagttttggattctgtctcctcaacacaaagagactgttgggctctgtttggatttttctccattatttgtactttaaaattgtatcaggcagtaagctgggcagtcagaagattaaccttgtttccgttttgtcagtgtttacagtccgttactgcatgttgtctgaaaaccattgtttaataaattttatctggattttagttgtttaaggcaggaggctaaatctgtcccattagtccataaaggcttgaagtacaagttcctccctggtttttaattatgatagaccttagtttctcattgtaaacataagttatttgagaattgatatgcgttttttttttaaatgttgcactttccacttgtgacataagaaaaaattgtcttacaggaacagaagaagaaagaaaaattggagagaaaaaaggagtctttaaaagttaaaaaggtaatatagccagccggaatattttttatgtcatttaaatattgaagaaatacttttgtattcttctgacttttttgatcatctgtttaattttaagtttctttagtgataaacctaactttgttacaagcaatgcagaaacatgtaaaatctgttcctcactatttaagaaatggagaaagagccaaagtatggtccactttagtttcttattctatggattattttggacgttggcaaaatttgactttcttaattggaaagaatctgcaaatttaaacttcaaggcattttgtaagtggccaccttctttgaaacctgtaatgaagttttgctagtgaaaagagaaataatttattgaatacatactgtgggtcaggtgtgctatcatgtcttctcttactctattttttttttcttttttgagacggggactcgctctgtcacccaggctggagtgcagtggcgcaatctcggctcactgcaagctctgcctcccgggttcacgccattctcctgtctcagcctcccgagtagctgggactacaggcgcccgccaccatgcctggctaattttttgtattttcagtagagacagagttttactgtgttagccacgatggtctccatctcctgaccttgtgatctgcccacctcggcctcccaaagtgctcagattacaggcatgagccaccacgcccagcctgttttcccttactctcacaacagttctttttaggtagaggtacttttttcccccattttacataaataggctgatgcaaggagataaagaacaatcatattcaaggattctatatttgtgaattcgcctactcacttacatttatttgtaaccccagagtcaagattcctgacaccgtcatggtcatttttggatatgcttatgttcagagcagcaaagaattttagtcctccaatacatatgttccaagctcagctcaaacatgggttgctgttctttgttttctgctaccatatgtatgtcaagcatatatccttttcatggtctttatttagcaccataacttttgcgtttttttgtgctttttcatggtgattttgctgttaaaatggcccccaactattgtaccaaagtgctgtctagtgtttctaagtacaaaaaggctgtgccatatggagaaagtatgtcttgggtaagcttcattgaggcatgaggtacagtgctgttggccctgagttcgatatttatttatttattttattttattttattttatttttttgagacagagtcttgctctgtcgcccaggctggagtgcagtggtgcaatcttagctcactgctacctccacctcctgggttcaagcaattcttctgcctcagcctcccgagtagctgggactacaggtgcgcgccaccatgcctggctaatttttgtatttttagtagagacagggtttcaccatattgggtgggctggtttcgaattcctgacctcatgatccacccgcctcagcctcccaaagtgctaggattacaggcgagagccactgcacccagctggccctgagttcaatattaatcaacatatatattaaataagatatctttaaaaacagaaacacaaataaaacagggttgtgtatcgtttggttgaaaatgtcataaccagagtcagagacccaagcttgtatttttcctaggggcaataagtcaatagtcatagtgattttatcgaaccacaagtactgcagataatgagagctgactctaatttgctgaaaattacggatttgaacccaggattagtttaagagcttctacttagcttctgtgctaaactgccttttatttatttattttttttttgagacggagtctcgttctgtcacccaggctgggatgcagtggcgtgatttcggctcactgcaacctctgtctcctgggttgaagcaattctctgcctcagcctcccaagtagctgggattacaagcacctgccagcacacccggctaatttttgtatttttagaagagacagggtttcaccatcttggccaggctggtcttgaactcctgatcttgtgatccacttgccttggccacccaaagtgctgagattaagtccagttatttgattcttagactagttaatggtgatgttaaaatgcctgataaagtattttgcagactgttttgcaacaaaacccattatttaaaactggtaatactgctaggtgtggtggctcacgcctataatcccaacactttgggaggctgaggcagatggattccttgaggcaaggagttcgagaccagcctggtcaacatgatgagaccctgtctctgctaaaaatacaaaaaattagctgggcgtggtggtgtgtgcctgtagtcccagctgcttgggaggttgaggcacgagtattacttgaaccacggtaggcagaggttgcagtgggccaagattgcatcaccgcactctagtctgggccacagagggagactctgttcctaaataaataaataaataaatacataaaactggtaatactgagtcactgagagagagagtattaaaaaataaaaatgggccaggcacggtggctcacgcctgcaatcccagcactttgggaggccaaggtgggccgatcatctgaggtcaagagctggagaccaacctggccaacatggtgaaacccagtctctactaaaaatacaaaaattagccaggcatgatggcgggtacctgtaatcccagctactcgggaggctgacacaggagaattgcttgaacctaggaggccgaggttgcagtgagctgagatcatgctactggactccagcctgggtgacagagcaagactctgtctcaaaaaaaaaaacaaaaaaacaaaaaaaaaaccctctgatccttgactcacttgctaatttcagagacttacctagggcttttcagatttttattttcatagagacagagcttcactatgttgcccaggctggtctcgaaccccttggcttaagctatcccccacacccacacccataccttggcctctgaaagtgctgggattacaggcatgagctagcacaactggccttacctaggggttttgaagaacatgtttttatttatatgacaattttactggcttagtcatttattccctgctctttaacctgttaatttaatatatccttcactttattccacctaactttttataccagggttttgatttttttcccctctgcttttttcataagggcgtcaactattttgaaacttaaaaaatttttttagaggtgatgtctcagtagcccaggctagagtccagtagcaccatagtagctcactacagctttgaactcctggggtcaagccatcttcccacctcagcctcctgagtagctgagactacaggtgcacaccaccatgctcagctaattttcgcattttttatagaggtggggatcttgctttgttgcccaagctggtcttgtactcctggcttcaagcaatcctactacctagtcctcctaaagtgctgggattataggtgtgagccactgcacctggccagaaactgtttcttaacatctcatttctcttaccttcctcactaataattttccattagtattctcttttatttctgctttgggttatatttaatgtatgaatttcattcacaatgaatattccttcaataccctacctattgaagggtattccttcaataccctaccctacaaaaatacctatttttgtatttttagtagagacagggtttcaccatgttagccaggatggtcgtgatctcctgacctcatgatctgcccgcctctgcctcccaaagtgctgggattacaggcttgagccaccgcgcccggccaagatgtacatggtatttctaaataaaaatgccaactatgggctgggtgcagtggctcaacgcctgtaatcccagcacttggggaggcctaggcgggcggatcacctgaggtcagaaattcaagactagctggccaacgtggtgaaaccccatctctactaaaaatacaaaaattagccgggcgtggtggcaggtgcctgtaatccccactactctggaggctgaagcaggggaatctcttgaacctggcaggcggaggttgcaatgagccgagattgtaccagtgcacactatcctgggcgacaagagtgaaactccgtctccaaaaaacaaacaaacgaaatgccaactatgtttaattttgaaatttctcttctaaatggaaaaaaatggacagaagtagagcccttgggaaaaagcagagattatgaacaagttatagtagggaaatacagaaaaatattacatgtaggtaagtataatagtgaaaaattgtggatgtggctcaattgcaggaaacatattttttctcaagttaatcagtgccttttaacgtataatactatgaaggtccttaataaaatcaatattctgaatccttgttttgtagggtaaaaattcaattgatgcaagtgaagagaagccaggtaaatatccttattctagttttgaagaatatgcgtttatatttctattttaattgctatcaaaaataaaatttttttttatagttatgaggaaaaaaagaggaagagaagatgaatcatacaatatttcagaggtcatgtcaaaagaggtaaaaataaaagggagagggcacctaacatttgatgttgagtaaaatgtaggttttaaaccaccttaaatctgtaaagattgaatattcaatatcacatgaaatatgttttgaatttaatattatatatcatttataggtgaagctgccaaaatgtttgaagctatctaccaacctacagtagacttgagactaatctgaaactaatgtcatctgaccttcatagacttttttttttttttgagatggagctctgtggtccatgctgccttgcagtgtcactatatctgctcactgcaacctccacctcgcgggttcaagcgattctcctgtctcagcctcccaagtagctgggataacaggtgccaaccaccacgcctggccaatttttgtattttcagtagagatggggtttcaccatgttggccaggctggtcttgaactcctgacttaaggtgatccgcccgcctcggtctcctaaaatgccacattacaggcgtgagccattgcgcccatcctcacttaagtggcaaataggcttacacctttaggttgttctggttttcttttctttctttcgtttccttcctttctagcttccttcttttttttcttcttttctttttttgaggcagggtatcactctgtgactcaagctggagtgcagtggcacaatcatggctcactgcagcctcgacctcatgggctcaagtgatcctcctacctcagccccctgagtagctgggactacaggtgtgtgacaccatgcacagctggctaatttttaaattttttgtagcaatgagatgtcatatgttgcctaggctgctcttgaactcctgggttcaaatgatctttttgcttcagcctcccaaactgctgagagtacaagtgtgagccagtgtgcccagctttttgttggttttcttttcttttttttttttttttgatgagacggagatttacccttgctgcccaggctggaatgcaatggtgcgatctaggcttaccgcatcctccgcttcccaggttcaagcaattctcctgcctcagcctcctgagtagctgggattacaggcatgtgccaccacacccggctaattttgtatttttagtggagatggggtttcagtgtgttgcccaggctgatcttgaactcctgacctcaggggatccacccgccttggcctccaaaagtgctgggattacaggcgtgagccactgcacccggcctttgctggttttcttatttgggttattacagataacagtaatagctttgactctacctattatcttgtgcttgttaagtacctagtggacttgtatagcattttgcaaggaactgtggaaacaacaggcatgggcatagagcttaaaattacatatatgttgcggagagttggggggaaagggtagggtagtaaagacactgtctgaccagagcagataagtatttcagggaaaaagatggtaccagctctttgttaaacgagtctgagcctggcctagtcagaaattgtcactataatttaactttttgtaacccctaaccttgtcttaagaactttattcttgttttttgttgaagacttttacgaaactgaaatcatatgctcttttctaaaaccagcttctttttttcatttctcactttttacttaaaaatatgaatgaattagagcatcttcagttctgacaaaccagttccttagcatgtttttaatgtgtcacattcttcctttttttttcttggagacagtcttgctctgtccctcaggctggagtgcagtggcgcgatctcggctcactgctacaagctccacctcccatattcaagcgattcttatgtctcagcttctgagaagctgggattacaggtacctatttgtatttttagtagagacagggttttgccatgttggccaggatggtcttgaactactgacctcaggtgatcctcacgcctttatctcccaaagtgctgcgattacaggcatgaggcaccactcctggccacattcttatatttaaaaaaaaaagcacaactctattgtctactgttgttcttttacctgaagttcaaactctagctcttcagaagaaaaatttacataatagttttccttttctctagggatgcaatgatagtttttcactgaaaaataatcgtcagggggccgggagcagtggctcacgcctgtaatcccagcattttgggaggctgaggcgggtggatcccgtgaggccaggagttcgaaacctgtctggccaacatggtgaaaccccgtctctactaaaaatataaaaattagctgggaatggtggcttgcgcctgtagtcctagctactcaggaggctgaggcaggagaatcacgaacctgggaggcagaggttgcagtgagctgagatgatgccactgcactccagcctgggcagcagagcaagactctgtctcaaaaaaaacaaagttagggtccactgaaattcattatggtatctattcaacttgcagtttaaaacacttttaggctgggcgtggtggctcatacctgtaaaccccggcgctttgggaggccaaggtgggaggatcacctgatgtcaagagttcgaggccagcctgaccagcatggagaaaccccatctctactaaaaatacaaaattagctgggcttggtggcacatgcctgtaattccagctacttgggcaggctgaggcaggagaattgcttgaaccccggaggcggaggttgcagtgagctgagatggcaccattgcactccagcctgggcaacaagagtgaaattccatctcaaaaaagaaaaaccacttttaatatgccatactgaagtttagccagtcatacagctgtttatttaatttgttaaatggttgtggaatatcggttttgggcaaactttgtcataggtggatgaaatccattagtaaagaaaggtaaatgctgtcttcaccttagcctgcatacagagagagatataggagtaagtagtcaatgaaattgaatttttttttttttgagacagtgtttctattaccctggctcgaatgcagctggcacaatctcagctcactgcagcctcaacctcccagactcaagtgatcctcgtatctcacactccccagtagcagggactacatgcctgtgccaccaggcctggctgatttttgtattttttgtagagatggggttttgtcatgttgtctaggctggcctcgaatttttgggctcctgcctcggcctcccagagtactgggattacaggtctgagccactgtgtccggttgggaattggatgtttatacaccatattagaggggctcttcactctggcatgcagttcctgaaccttttcatctatgaaaaggaaatgatatctgtgttgtgacttgaaggataaaagttaaattatttaaaggtgggattaatagggaaagagtaaagtacaggtaagatagtgggggaggtgttttaggaagaaataatagcattgaacaaatatccagggtcaagagagactggcagtttcaaaaaacttgaagtaaattatatttgcctccaatttgtatataagtgaaaagagtgatgaaggaaggatgaagctgtcgatgtaagcatggtcaggagtttaaggctgccataagtaaagtaggaagctattgaaagattttaagcaaatttccattttggtaaatcacttggctagtttattcagagatctgtgggcatagtagtttttctttctttctttttcttttctttttttttttttaagacagagtttcactgtgtggcccaggctggagtgcagtggtgatctcggctcactgcaacctccgtctcccagttcaagcaattctttcacctcagctccctgagtagtccagcgcctgggactacaggcacgtgccaccacgcctggctgtttttgtattttttcatagagaggtggtttcaccatcttggccaggctggtctcaaactcctgacccgaagtgatctgcttgcctctgccttccaaagtgctgggattacaggtgtgagccaccatgcctggtcccataccagttattctttcatttactgttacttctttcttctgtatatttactgaatttcctgctctcttttcctcttcgcctaactaaattctttccattgtttcattctcaccttacttgctgaagaatctctaaatctgtgaatgcatttggaggggtataacccaattgagtgttctgccactgtggaccctgctcctccaagttatcccttctgtttcttcaccttttccttcctcactgggtctttgcctttcaattatagatacattgtgttttcctgtctgcagaacaaaaatttttgatccagtctttctagattgccctgttttttattctttatttccaaggttttttttgagacacagttttgctcttgttgcccaggctggagtgcaatggcgccatctcggctcattgcaacctccggctcccaggttcaagcgattctcctgcctcagccttccgagtagctaggattacaggcatgtgccaccacgcctggcaaattttgtatttttagtagagacggggtttctccatgttggtcaggctggtctcgaactcccgatctcaggtgatccacccaccttggcccccaaagtgctgagattacaggcatgagccactgcaccggcctatttccaagctttttaagagtaggctggactggacatgatgcctgacacctgttatcccagcactttgggaggccagggtgagaggatcacttaagcccaggagtttaagactagtttgggcaacatggcgaaatcctgtctctacaaaaagaaatacagaaatagccaggtgtggtggtgcatgactttggtcccagctacacaggaggctgaggtgagaggatcacctgagcctggggaggtgaaggctgcagtgaggtgagattgcgccactgcactgcagcatgggcaagagaatgaaaccctggttttttttttttttttttttttggagagagagtctcgctctgtcgccaggctggaatgcagtgctgcgatcttgactcactgcaacctccgcctcccgggttcaagtgattctcctgcctcagcatcctgagtagctgggactacaggcacacgtcaccacgcccagctaatttttgtatttttagtagagatggagtttcaccattttggcctggatggtctagatctcttgaccttgtgatccatctgccttggcctcccaaagggctgggattacaggcgtgagccaccgcgcctggcccttttttttttttttttaaagagtagcctgtgcatatttccttacacattatgcagttgagcagttttacgcctaccagttgaatttattggtatctttgaaattgatacctagcacaaagcaaacaatttatcttttcctctcttccgaatcttgctcttttgttttctctttttttggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatagtagtttcttaattgatttttataatcctagtctagctctcattgtcaagagtaccagattggtttttctgaaactcaaatataattactcataacctccattactttttatggtttcacaaggaattgcattttcttgtagaaaaatttgagaataaacaaaatacaaggaaatcacctgaaaagctgtcacacagataatcactaacattttggtatatgtatgttctttttctttgtattacggaaaatctcaaaaattacaaatgtttagaggatagtaaattgaatgtccacctttatcactttttttttttttgagatagagtttcactcttgttgcccaggctggagtgcagtggcatgatcttggctcacagcaacatccgcctctcaggttcaagcgattctcctgcctcatcctcccgagtagctgggattacaggcatgtgccatcatgctcggctaatttttagttttatcagagatggggtttctccatgttggtcaggctggtcttgaactcctgacctcaggtgacccgcccgcctcggcctcccaaagtgctgggattagaggcataagccaccacgcccagccaatcgctttttaattctgggatattttaacaaaaagctcagcaagactttttttttttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactataggcacttaccgctgtgatctgcttagctcatacattttaaaaaaatagttggttcaaatcaggatccgaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaaaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggtaagaaatttataatgtaagattaagtttagaagtcatatttactcctcagttactagtcctttttctttaatcagcagtatacgttcttctcactattatcctgtttctttgctttaaaaaaaaatacctatgtattcacttcttccatatccaacattcttcttttttatgtatcaactttagttagttgttttattgcatgattcttgatgtataaatgttaatttatgggtctagcaatgttgcttttaacttgtgaatctggcagtgatacaagtgctcgtaaccatgtggatataaaccgtgaatcatcttatggaagctgtgagggatgccttaatcttgcttcagaccttaaagattttttaagtttcttaaaagttctgtttgagaaggcttgatttccgagccacctcttcacttagcccatttcatgtagagaggttccttgttatctgactttttattgttcaagtacttaaaattacaaggttgcctagggaagcaaaataatcatgacatgaaaatattcatgaatggatatgaacttcaggtagttaatttacatattaaagatttttaggcctttgggaaattaatgttatgtttataaaatgagagataatctatttggtcatataattttgtccaaaatttatattgtaaaagtgtcttggtttttattctttgttaagttattaaggactggtttatgggtgcagtttagttggatttttaaagatttagttagataaacatttagttggatttttaagataaagtctagatgtaatcttctgtaatttactatgggattttggcttcattttataacttacagtcagtaagaaatagttgttaagtatggtattttaatgaatttcgacacttgcatacacttgtgtaaccaccatccaaatcaaggtatagaacatttccattgtaaagggatctcttctatgtctttccacccccaaacccagaggaggccactttttacaccttttataggatggcttattatttcctttccactcaacatgtctgtgatactcatttatgttgttgagcatattagtaaccggtttcttcttattgactagtattctgttgaatgaatgttacaattttctcatccatccccttattgatgggcatttgggttgtttgcagtttgtgacttttatgagtaaggttgctatgataatttgcacacaagtccatgtgtagacatgttttcatactttctgcctgtgtacctgggaatggtattgttgtgttacgtggcaaatgtgtgttcataagaaagtacagattttcccccccaaagtaaacacatcattttattctctcgccagcaatgtttgaaaactccagcttacattattgtcagcatttgatagtctttttaatttcagccattttattagatgagaaatggtaacttgtgtggtttttaacttgcattttcctaattactactgaagtagagtatatttttatgttctttgataactatgttttctttctttttttttcttttttgagatggagtgtcactctgtcgcccaggctggagtgcaatggcacgatctcggctcactgtaaactctgcctcccaggttcaagcgattctcctgcctcagcctcccaagtagctgggacaacaggctcatgccaccatgttcagctaatttttgtatttttagtagagacagtgtgtcaccattttggccaggatggttttgatcacttgacctcatgatctgcctgccttggcctcccaaaatgctgggattacaggcgtgagccaccatgcccggcctgtatgttttcttttgtaaagtatctgttaatatcttttgcccgtcttatttatgcgtactgtattttctgtgtaacagtttaataaattattgagtatcacaatattagaagtttggaagagagatacaattctaatgatcttttcaaaagtatgtgcctgattttaatttgtaagggttattctcagatttttatattttattttattttattttattttattttttgagatggagtcttctgtcacccaggctggagtgcagtggctgtgttcatggctcactgcagccttgacttcctgggtttaagtgatcctcagcctcccgagtagctgggatacaggcagttgcgtgcaaccacacccagctaattttttgtatttttagtagacacagggtttcgccatgttgtccagggttgtcttggatacctggactcaggtgatcctcctgcctcagcttcccaaagtgctgtgattgtaggattagccactgtggcagcctgttatttttttttttagtagcttttcatttgtagagggatggcgatgtctccagttttttaatccaggtgtgatcttagtcttctatacttaatgattataggactcagtagattttgttagttgcattttctgataaatggtggcatacagcagcattttgtataacacatcttattaaactttttttctctacaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttccagtgttgttataatttatggtgtgaatatatcagctttaacataattctcatctttgggtgtgattttttaaagagaagaaataaaatattgtaatcctgtagttgtttatatccaagtttaaatacagtatctattattttgtccagatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatgtaagacatgcttccttatgttaaaattataattttacatgttttcttatgctttgttgtagtaggaattaaattgtagaactcttataattatattggtttctgtataaatattttgtctgatttgacttactcaatctgcacaataccctaatttaaatttatatagtataggttttggaaatccctgacatctttcctaaaatattcctgaatgattttcagtgcattggtaatttgattcgactgagacagacttaggtagagattttattaaaaattctgcttgttcttcacttgatctttgccaaaaggctaagaagagagttttctgttttttctgtacttgttaccttctgcaatttttttttttttttttttttttgaaatggagtctctgttacccaggctggagggcagtgatgcagtcttggttcactgcaatctctgcctcccatgatgaagcaattcttgtgcctgagccaccggagtagctgggattacaagcatgtgccaccatgcccagctaattttatgtttttagtagagacgatgtcttgccatgttggccaggctggtcttgaactcctggcctgaagagatctgcccactttggcctctcaaagtactgggattatagacgtgagccactgtacctcccgggcccagcccttctgcacatttttgccttatgagaaatatatatattctagacgtagtatcaccatctgtctcattttatatatttatatatatattatttatttatttattttgaaatggagtctgtctctgtcaccatgctggagtgtagtagctgggactacaggcgcacaccacaaggccaggctaattttttgtattttggtagagacaggatttcaccatgttggccaagatggcctctatctcctgaccttgtgatccgcccaccttggcctcccacagtggtgggattacaggtgtgagccactgcgcccagcctatatgtgttttatgtatttgtaggttttttgttggggggggggttgtgtttgtgtgtgtgtgtgtgtgtgtgtgtgtgtgtgtgtgtgtgtgtatgacagagtttcactgttgttgcccaggctggagtgcaatggcacgatctcggctcagtgcaacctccgcctcccgggttcaagcgattctcctgtctcagcctcccaggtagctgggattacgggcgtgcgccaccacgcctggctaattttgtatttttagtagtgacggggtttctccatgttggtcaggctggtctggaactcccgacctcaggtggtctgcccgcctcagcttcccaaagtgctggggattacaggtatgagccatcccacctggcccgtctatttgtttttatgcctttttttttgtcttcagacaggatgttgctctgttgctcaggctggagtgcagtggcgtcattctggctcactgtggccttcacctcccaggctcatgtgagcctgctatctcacacgcctgagtagctcatgtgaacctcccatctcactccactgggtgagtagctggcactacgggtgcgtaccaccacaccagctaatttttgtattttttgtagagatgggatttctccatgttgctcaggttgatctcgaactactggactttagagatcggcttgccttggcttcccaaagtgttgagattataggtgtgagccattgtgctgggcctgactttgtttttttgtttgtttttttttcattttctcccataatagttcaatgatttgttagaattgcttggcttattttgctatagaaaaatagaaataaaattttttaaaattatattttttccctcagaatgatttatattttctaaatagtcaatatttacattttgttcttaagtctgataaaaatcaatataaaatttttcagatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacaggtacaaatgatcttcattggtttctttgtaatacataaaacatgcttttcttcatttatatcactttctcaccatctgggagcatttgtctaatttttttttgttgtcgaaataatagattatattgtgcatatacctgtagaagctggaaacttttattaacagaatgattgggatgaaggccatcatttgtaacaatataattaaagcttatggcagtttaacctatggcttagaatcatccagaaatagacctaatctcggaatgtattacagatatatttgtgacaggtactttgaatatatggaatttacttatcgtattttaatcaaataagagtatttgaagacaagttatttttagagtatcttattggactatttggtagcattttcgtttctattttcttgatgttctagctacttatttaaataatttccagttagcataacagaattgaaagattgaccttttttctttcatgccttctgttttcatttattggtgttttgaacttcttcctcactgctctacctcattcatttataattcttgactgctttttttttcctttctctggccatgtgagaaccctcttagtgcagtccccttaggtttatcttgcttgcttggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggccgggcatgaaggcttatgccagtaattccagcacttgggagtctgaggtgggcagatcccttgaggccaggagttccagaccagcctggccaacatgacgaaaccctgtctccactaaaaatacaaaaattaggccggacgcggtggctcacgcctgtaatcccagcactttgggaggccgaggcgggtggatcatgaggtcaggatatcgagaccatcctggctaacaaggtgaaaccccgtctctactaaaaattacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggccgacagagcgagactccgtctcaaaaaaaaaaaaaaaaaaaaaaaaaaatacaaaaattagctgggtgtgatggtgcacatgtttaatggcacaaggattgcttaaacccaggaggtggaggttgcagtgagctgtgattgcgccactgcactctagcctgtgctacagtgagagtctgtctcaaaaagaaaaaaaaatttaaaccagtagtccccaaccttttggcaccaggaaccggttttgtggaagacaagttttccatggaccatgggtgggggatggtttcagaatgattcaaatgcattataattattgtgcactttatttttattattataaaattgtcatatataatgaaataatagggctggccgtagtggctcacccctgtaatcccagcactttgggaagcttaggcgggcagatcacttgaggtgaggagtttgagaccatcctggccaagatggtggccaacatggtgaaaccacatctctacaaaaatacaaaaattacctgggcatagtggcctagctccttgggaggctgaggcaggataattgcttgaacccgggaggcggatgttgcagtgagccgagatcatgccgcttggttggctgggcaaccaagtgagactgtgtctcaaaataataataattttacaactcaacataacgtagaatcagtggtagccctgagcttgttttccatctagggatgatgggagacagtgacaaatcatccaccattagatttttataaggagcgcacaacccagacaacccagatcccttggatgtgcagttcacaatagtgttcatgctcctatgagaatataatgtctcctgatctgacgggaggcagagctcaggccataatgtgagcagtggggagtggctgtaaatacagatgaagcttcccttttctgtaaatacagacgaggcttccctcgctcacagctgcttacctcctgctgtgtggcctggttcctaacatgccatggacccctacaggtctgtgacctgggggttggggacccctgatttaaagcatttctttacagtaaaagtaatatataccaattttttttaaagggtagtgtacaggaagatgtaaaagcacctgtaattctacctgagaactactacttttttctttttttttttttttttgaggcagagtcttgctctgttgcccaggctggagttcagtggcgcgatcttagctcactgcaagctccacctcccaggttcacaccattctcctgcctcagcctgccgagtagttgggactacaggtgcccacaaccatgcccggctaatttttttgtatttctagtagagatggggtttctctgtgttagccaggatggtctcgatctcctgccctcgtgatccgcccgcctcagcctcccagagaactactacttttatactaaataattatagctaacatgtaggtataatttacacatatgatcatactatacattcaatttttttttttttggtccgagacagggtctcactttgtcacccaggctggagtcctgtggcacgatctcagctcactgtagcctgaatctcctgggctcaagtgattctcctacctctgtctcctgagtagccgggactacaggcgtccgtcatcacacctgactgattcttgtatttttttgtaggaacagggtgtctcaagccatccaactgtctaggcctcccaaagtgctgggagtacaggtgtgagccaccacttccagcctgcattcacttttgcaacttgtgttttctactcagtagtataacatgaagacccttcctgtaatgaaatagttaagcttccttgtccatttcctttgccagtggctagaaacttttgactttttccatttaagtgagcttatattatcatttcaaggatcttagcttactctggtaacggagtgtgaggttccagggcttttgttgctgagtgcgagtggaagtgactgagttcacttgctaatttggctttcagattcctcatcatttatttccttgttttcttttctctcacatacccattataaaagtatatatatatatatatatatatatatatatatatatatatatatacacacacacacacacacacacatttttttttttttttttttgagacagtctcactctgtcacccaggctggagtgcagtggcacgatctcggcttactgcaacctgtctcccgggctcaagcaattctcctgcctcgcctcctgagtagctgggattacaggcatgtgccactacgtccagctaatttttgtatttttagtagagacggggtttcaccaagttggccaggctggtctcaaactcctgacctcaggtaatgcgtctgcctcggcctcccaaagtgctgggattacaggcctgagccactgcgcccggccaaggatattttatatttttatctggatttttagatagctgtcttacagtgagagataattcaggttttttggtttaacatattgccaggaaaataaatcctttcttggttattttaataaagaagatacagtactataaacttttttcattcttttgggatgtataaagcaaaatgcaaaacgttctctatactctttcctcaatttgtcagtcccattttttaaggatagttatatttttcagattgttatttatatttccagaaatacttcatatttctgtatgttaatataaattagattaattataaattttcctgattaagatatatgagaaatcacagatattaaaatgagaaagttaaaacaatttccttgataactttatgaaagtgagtgggtgactttctgtgaaaatataaattgcttaaataagggaaaattctagtgctatttgatgtttcagcacatatggaactaataaaagctcaatttttagtagtctagtgtaacattaatatcaaaacttgggaaaatattagaaaagaaagctacaactgcgttgactaaggtgtgaatagggaaatcttaaattcaaaataggtggagttcaaactttattgcatattttagtaggtctcttccaggaacagaaatatctatcagttttaggaatccttgtaagtggatcaaatgaaaacatgatcatttcagtagttactgaaattacatttgataaaattcaacatccatccctcataatagaggttttatttttagaattcttgttagaaaaattgtgagatcattgtttaaaaatctttttcctcaattcgttttctagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaaggtgggtaagccagttatttaatgatttaacctcaaaaatctgtgctgttagttaaaattactttcttttcagtgactgaattaaaatgccaaatatttggcaagttctttgtggtgtatattgtatgttctactcctgccacaaattatgtgagagcagattaagaaaagattatttaaaacttacttgcattgattaaaggaagactgctgaatgcaactttaagataatatttttataataaggttcttttatgtgttacctttgtaaaacattttaagatggatttttcttactatatcctcattaaacaaccagggacaatagagttgttaaattatttcctatctcacataaaagaaaacctaggtgtaaagttgttacaagataagactagttagttagcaccagagccaaagttaaaaccaaggtctcccaatgtaaacacagtgttttaattctggaaactgtttgaatcttagcttatataataaaatcagacataaaagtagttttcagaaagtaattagtagcttcagaatggaggaggaggtaatgttgacataatttaaaactgattacaacggaaatataacttgggcaaaaaataatttatacttgttttggcatcagtgaaggaagtaagctaattgggtgtggaaaaataattttaaattttgggaatttatttcaaatctggttaccgaatggtggctcaaggcaggctaccttattgtgactctgggcgcttttattgaaagacaagaattccaggtcctgtgcagacatactgagttacagtgtcaaggtaggagttgagaatctgagttttttgaacatgcttctggtgatccaagtttgggaacttctagtctactgcataaatgttactagcattttccagaattgggtataatgttacctattctatattattaatctgcatgctcatacttaattgctcattgtaatatatatattttcaacattgggaaggaataagcatgtatattattgtcaagttatgtatatgttgaattttaaaatatttattgtagtgggccatacttagactgatggagaaaaatcatatggctttggttttcagagatagttctcacttttgtaatgtaaaattataaatatataccttaatcttatttttgatttttatactactgtacaattgttaatctatttataaatcagaaaagtgttccctttaagctcacagttcttgatggttcaaaaatgcaaccaatttatctttgttgttggaatgtgttctcttccattataaattttaaaaattgcacctaaggatttgatgcaacaataccacgtttcattatcagattattactgtaaatgataaatcatgtatcatgttgacataattgaatttatgtgatggttaacttaaacatttttctcttccagctttgagtcttggtttgacatcactagtctttctgaaactgctgaagatattattgctaaagaaagagaacagaatgtattgcatatgctgcaccaggttttccatgttttcttattctgcttaaccataggctcgatagagtataaaaggaactctggagatcacctgtctaaccctttgtagtagagatttgaaaaatgaagatcctcctacatttaaatgactcctttgtcctttcttctcccagaggtcacatggttttatgacagaactcaagtgcttacctaagttttgtccttttcagatagtatactcattttacccctaatggttactgataagtttgtcaagcacaaaacagaagtatgtggtttttatggaatgcttgccaataatacttttataatttacatccttgcatggctgctgtctaatctatttttattgcttcctgtaattcctaccccatcctacctatctttaatttagagaaacattatctttcaagggtaatctagtcatatgggcctgaaaagcttctcagttgtggtttagcaattttattcaaagtctttatcgttttttctgatattaaagtttatacatgttcatgagaaaaacgtgaagcaggagagaagtgaaaagtaaaaatatcacttcctcttaaaattgtatttcctagcagtgcatgtggaatgattatgttgtgttatatgacaatccaaactcttttctgtctttgtgtaaacacgtgtgttttatctatattttatgaagaaaaggactttaaaaataaaattgttccttaagatagtcttttaaacagttatcagaaaattattttccttttactacatgtagatttaaatcagtttttaatagctgcttattatcccattgtcttgttctactataattaataatatctatctcttcctcttttcaaaattttcaacaatataaacaaggttgtagtatctgtatttaaaactacacctttgcccatttctggctatttccttaggaaagaattcctagaatgtatgtgtcagagtttacagatgagggcttctttgaaggcaaattgccctccagaaaagatttatatgatatacgtccatatgaaaatacttatttactcaagcttcataccaattttgaggttagaagtccttttcagtgttgcagagattaaaaaggatgattattgctgaattgagatgtttattgactattggtagttccttgtggccatattccaacatgtgttggaatatttatttattaatggtttataataactatatgttaaaaataagttaatgttgcaaataatttctttcccctcactttttgggataaactttgtttatggtatctttgtgtgtgttcatgtgcacaagcgtgtgtgtttatatttaaaattttctttttttcccactgtgactctgggcaatgacagaaatttcaatgcaccaatagttatagaagcttttaaatgtcccagtctgaattattggagtaaatgacttatttaggaagagatgtgtttggatatcacatcctcatcagtagtgtatacatccatatagtgtagcaaaggattaagtttctgttcttaggaaatttaattagagtcaagacaatgaatatttatagaatttgtcacttacacgttacctcacagtgtatacaggtagatagatattccttagaaatgatcatctgccttttgattgaacatttgtagtaattgtcatagttgataattccataagagggctcactggaattgttttactatagataacttcagatttccattaatattaagatatgataatgaacttttattatatccaaattcaacagttttatcaaaaataggggcagttttgaatgttctagcaataagaatattctctgtaatactgtgcttaaatttgagtttatattacttttacgctttgtcctaattatgttttaatgcattactacaggaaaaagttttcattcaaaatgaattcagattaggtggagatagttttaaatcgctagtatattttcttaactattttctatatgaaagaattcctttcctttttttatgcaatgtttacataaaccttgcatagtaaaaaaaattttttttactttccgtttaaagttctctaagcttgctacttttctatttccaccccatattgaaggccaaaagcagtataacctttacaaattaattatttaaaattttttattttaaaattatgcgtacacggtaagatatttttaaatgttataaacatttagaaattaaaaagtaagaagtaaaaatttctgttttccttctgcacttcctttcttatctccaaagtataactaatagtttttttgttttgttttttttttttgtttgtttttgtttttttttttgtttttttggttttttttttttgagacagagtctcactctgttgcccaggcctggagtgcagtgagcgtctgcctcccaggttcaagcgattttcctgccttagcctcctgagcagctgggattacaggcgtgtgccaccacacctggctaatttttttgtatttttagtggagacgaggtttcaccatgttggccaggctggtcttaaactcctgacctcaagtgatctgcccgccttggcctcccaaagtgctgggattacaggtgtgagccactgcacctggccaacagatttttttttttttttttagagacaatgtcctactatgacatccaggcaggagagtagtggtgccatcgttggttattgggttgttatctgcagcctccaactcatactcctgggttcaagtgatcctcctgcctcagccttctgagttgctggaaccaaaggtgcatgccaccaggtccagctaatttttggtagatgggtcttgtataagtcttgtttttgtctgctttgaaagcttgtatactaggaaaaacatatataaataccttttttatacatgtgtttcagcggtatagtgtgcctcttcttccacatatttgccatttcagttaacatcaaactatagcatttgtcagtgcatgtggtagaaaaatatctggttatttcatgttttccttacagacatggacatgttttttttaattttatttatttatttttatttttttgagacagaatcttgctctattgcccaggctggagtgccgtggtgcaatctcggctcactgcaagctgcacctcccgggttcacgctattctcctgcctcagcctcccgagtagctgggactacaggcgcctgccactacgcctggctaattttttctattttttagtagagacggagtttcactgtgttagccgggatggtctcgatctcctgacctcgtgatccgcctgccttggcctcccaaagtgctgggattacaggcgtgagccaccgcgcccggccggacatgttttaacatgtttatgaaacatttacatatttttcctgattgcctgtcggcatatttgtttttgggttggtagataccaacactggtaatgtgtttactatctttggtaatagtctgtctatgattagctctatacctgttgggtatttaagtccagagtcctgaaaatgagctttattatatatgattactatatgtaaaccattgtcagtatttaatggcaggggtataaagagtatacaattatttgtttattattattagtagtagtagtagtattttttttgagtcaacgtctctgtcgcccaggctagggtgcagtggcaagatcttggctcactgcaacctctgtctcccaagttcaagccattctcctgcctcagccttccgagtagctgggattctgtaatcccgccaccacgcctgactaaatttttttgtttttttagtagagacgggatttcaccatgttggccaggctagtctcaaacttctgacctcaggtgatctgctcgcctcggcttcccaaactgctgggattacaggtgtgagctactgcgtccgacctagagtatacaatgattttaatctagtatttgtgctcttttagtgacccgaatattttaatgcataattattgtctgttgcttctgtgttctctttataaatgtgataatcatttgtaaccaccccagctaatgaaagagaataattttaagcctgaaactttagaacttatagaaggaaacttgtatgtctgcatccctaggtcagctggctttttactgagtcttaaaacctcattctattaaaaaatttttaatttttaaaaaaacttttagttttttgggtacatagtagatgtatatatttatgaggtatatgttttgatattgatacagaaatgcaatgcataataatcatatcatggagaatggggtatccatcccttcaagcatttgttaccctttgtgttacaaatgatccagttatacacttttgtgtgtgtgtgtgtgtggagacagagtcttgctctgtcacccaggctggagtgcagtggcacaatcctggttcactgcaacctctgccttccaggttcaaacaattctcctgcctcagcctcttgagtagctgggattacaggtacccgccagcacacccagctaatttttgtatttttagtggagatggggtttcaccatgttcaccaggctggtctcaaactcttgacccaggtgattcacccgtcttggcctcccaaagtgctgtgattacaagtgtgagccaccgcacctggcctctagttatactcttctttatattttaaaatgtaaaagttaaattattattgactgtagtcaccctgttgtgctaccaaatattaggtcttattatttctactttttgtactcattatttcaaatatttttaatttttattcatttttattatttccccttttgtatggtgctgataacatctcattctaaaagttgtgggctataactgaaacttcaaccctaagaaatacaaatgctacctttatatttttacttttaaaattatttgagatagattcttacagtttttaaaagaaaataaattctgaaatgctgcggacaactgtgagtttatcatttggtctggtctgggaaaatctcaagatattttcaccttttgagatttggcattatttatataggaagtcaaaagataaggtaaaggagtatatggggacagtattccttgaaaaacaagaatgtttaatactcatatttttctgttcatgttttaattttagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgaggtatagtggttttgaaatgtactgtaaatgaaacttgacatataaaatttctcttttttccctttttttttgagagaaggtgtcgctctgtcacccaggctgtggtgcagtggcacaatcactgctcactgcagcctttacctgcctggctaaattttttgtatttttttgtagagactggcatttcgccatgtttcccaggttggtctcagactcctgggcttaagcagtccacccaccttggcctcccaaagtgctgggattccaggttttagcaattgtgcctggcctaaattccagttttaaggtccccttgttcatttttaggacttgggtgaatttctaactggggtataaggcataaggcttagtggcaaaagttgtttcctagtatctggagtcctgctaaaatgttaagtgataatctttgtattaattgctttacagtcatctggaatacttactaaaaatttaggccaggcacggtggctcatgcctgttatcccagcactttgagaggccgaggcgggtggatcacctgaggtcgggaatttgagaccagtctgaccaacatggagaaaaccctgtctctactaaaaacacaaaattagctaggcgtggtggcgcatgcctgtaatcctagctactcaggaaggctgaggcaggagaatcacttgaacccgggagacggaggttgtggtgagccaagattgtgcctttgcactccagcctgggcagcaagagcgaaactccgtctcaaaaaaaataaataaaaaaaaaatgtatatttccgtacagattaactctaatcatgctttctggagatgaacttggaaatgcatttttaacaagcacacaggtaggtatttgagaatccctgtactaaggacttggcaactagactaatctccagatatacagattgagcatccaaaatctgagttgctccaaaatttgaaactttgagtgctgatatgaaactgaaaggaaatgcttattggagcatttgtattttcccgttagggatgttctacctgtacagtttccttacagaaggttattgataaccaaaaagattaataatcaatttgatgatgattattcatcacccaccatattataggagatagaggtgggatgttattatcatgtaactgaaggagacccttaagttttgtttaactttccaggttttttattgtacactataaacctacgtattttcttttcaaaatatttattgtgatgcatttttaaacaataggaccaccagactcttctccccccgacttttttttttttttttttttttttgagacagagtctcgctgtgttgcccaggctggagtgtagtggcatgatcttggcttactgcaagctccgcctcccgggttcatgccattctcctgcctcagcctcccgagtagctgggactacagtcgcccgccaccacgcttggctaattttttctatttttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaaggtttgaattcaaaagtgaatttaagtattctttaaactgtgaccattttttgcatttcccatatatgcattatttgttttggtagagctgttgtggaagtgaatatccctgtagaatctgaagttaatctgaagctgcagaatataatgatgctacttcgtaaatgttgtaatcatccatatttgattgaatatcctatagaccctgttacacaagaatttaaggtgaatactgtttaattctaatttactgttttgatttccattacttttatattggtggaaagtgttactttttttgattataattattaaaaataagtatggtgctatttgtcatgaagattgtaatccttcagtaagctgagacagtcttctttccgaaatttcagagaaccttatcagggttagaaaaatggtcactttctatgagcaactagttttttaaatttttttattttttatagagacagggtcttgctatgtttctcaggctggtctcaaacttcctggtttctcaggcaatcctgcctcagcttcccagagtgctaggattacaggcaagagccaccacgcttggcctctatgcaacttatatttttatttacatattttatgtgaacaactaagaattctaaatttagtaattgatttgtactctgcatgtttacttgttatattttagagagagtggtcatcttttcactatttcttttatcattaatatttggcttatcaaaatcagcctggttgctcattgcttaaagatcaacaggtagccatagaataaaaccagttttgatttggaggttttcaaattaagtaaatgaagttgctttcttgggtagttgatagaatgatagcataatatcaatagaaataaattcttagtaaccctcaatcacagttgtttcaaggtagtttacaataggcttttccactcctggcaatattgacattttgggccagataattctttcttaggaggtaatgttctgtgcacttaggacatttagcagcatccctgtcttctacccattagatgccactagtattcacttccctcagttatgacaactaaaaagtttgctgccgctgccaaatataccctggggataggtggagggcaaaattgtccccatttgagaggcactgctttacatctttattagagtaagaaggaagacaaaactttcccactcaaatgaaagtagctctctcatgagggaatttcaccagaaggtgaaaaagtctttgtccacaatatttagattacttatcagctcctgtattttctcttaatttctggtaagaattctagcagtagtttacatatacatttagttggaaataactcacttataaagaataagcctgagtatgtacccattaagtttgacataattgttttctttcacaatgactttgagagaggagtgttgaggttagatcaaagttatatttgtactttgtttttgtgaaattgctggttttacattctagagtatgtctttgagtaataactatcttctgattttacaaagattgaataacaggtcagtttttaagttttttaagtgacttggctttgaaaattgaactttccaaatggcttttgttttaacaaagcaaataacagttttctctctattttttcttcctttgcccctccttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacgtaagactacttatgtcatacataccaaactattcttttataattcctatcttgatttctgaagtaatattccaaatagacccacaaattgataaaaagatagaaatgaccagaaaccctgtggttttatcaaaaacaaacattttgatttagtactaagaagtcttaatttttgattcacaaatatatatatcttctggcacaatcttattaataatatcctacttaaccatcactgtaagaatattgggatagcaggaaattttttgcctttttgccctgtcctcaactttctattatgaaaatatcaactatatggcaaagttgaaaaaaaaaaagcaactgtaaatccgcctacaatctgctgttaacatttgactatacctttttaaaaacacatttcctgtaatagcagccttgctgtatccattcagcatttaatcctggttttttggtgcatttaaaaataaaatatagatgatactacccttttccgtaatgacttcagcatattttatcttttggggtaaaatttacacatactgaagcaaataatgtatacatttgctgaatctttctgacaaatgcatatgtaaatttatacctaacccctattaagatatagaatgttaccatcagcccagaaagtttcctgtgcccccttctagtcaattctcccctgcacccaccccatgtgtttagacaactacaattttttcatcattttttgatattagcttttcttatttaaacattgttgtgatacatggtttttaacaaaattaagatctctttaatataggtgcttggacgataaagctaacagcacaggttttgttaacataattgttttatagatctgaatgatttgtttggcctcctttgtttaagtctttaatagttgtaattgaaaacatttttctccttcagtcttgttggttaatttattttaatctgttgtatttacatcctttttgcttttagatgcacagcttcaacacggatccagaggtgtttatcttcttagtgagtacacgagctggtggcctgggcattaatctgactgcagcagatacagttatcatttatgatagtgattgggtaagttggaagtatagcaaggaatatgctgattatatttccattttgaatttttttttttttttgaaatggagtctcactctgttgcccaggctggagtgcagtggcacgatctcggctcactgcaaccttcacctcctgggttcaagtgattctcttgcctcagccccctgagtagctgtgactataggtgtacaccacaatgcctggctaatttttgtgtttttagtagagacggggttttgccatgttggccaggctctcttgaatcctgacctcaggtgatccgcccacctcggcctcccaaagtgctggcattacaggcttgagccaccacacccagcctccattctgaatttttttttttttttttttttgagaaggagttttgctcttgttgcccaggctgggattaagtgctgggattaccagcatgagccaccgcgcccggccattctgaatttttaatttttaatggtacatgttacaaatttacttatctattttgaaaagatacccattttcagctaagagttatttcttcataaagttttttgcaagtaaaaattgaaaatttttttttacttttgtttttagtgacagggtctcactatcacccaggcttgagtgcagtggcaccatcacggctcagtagccttgaccttttggattcaagtgatcctcccacctcattctctcaagtagctgggtctatgggtgtgctaccatgcccacaaaaaatgtaaaaattagtgagaccacgtctcactgtttgcccacgctggtcttgtatcctcatatgatcctcctgccttggcttcccaaaatgctgagattataggagtgagtcatcgtgcccatcctgaaatgttttctttagggtatttaaacttttttgttaatattgtcaaggatctgtggaatgataattttgtctatgaagccactctggaagtttaaattaagacaccactatttaaaagttcctggctagatcattcatgttgactttatccacatgagtttatgttaattttaacctaataccgttaaatattatttttctttttaactttaagaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaagtaaataacacttatgtagtgctttattgtttaaattgtgcattgtgtgttgtggattttgtttttattttgtttataaaatattacagcctgggccgagttctgtgtctcacacctgtaatcctagtactttgggatgccaaggtgagtggatcacgaggtcaggagttcgagaccaggctggccaagatggtgaaaccgcgtctctactaacaatacaaaaattagctgggctcggtggcgggcgcctgtaatcccagctactcaggaagctgaggcaggagaatcgcttgaacccgggaggaggaggttgcagtgagccgagatcgtgccactgcactctagcctgggtaacagaacaagactctgtctcaaaaaaaaaaatattaacagcctgatatgacaggatttaaataagcagtggggaatttgggagcctaaactaagttggtcaccatagacataaaagaaagaatgttagcgagtatgtagatatgtagatgaagagcagatgggcagagaaaaggggtcaaggataactacatgttcctgataagagattggcttgctaaaagttttaagataaatattttgcaagttccatgtattaaaatattaagtgtatttaagtgttataaaaaatctatttatttattgaacccactgtttcacagaatatttcactgcagaatgccctttttatagttttggacacttttttttcctttttcatttccttatcataaccagatgggtctcaacaatgctttttaatctagaaaaaattctgaggaggtggggaactgacataggtgaaaaagttttgttcctgagattccttagagaagttatacttctatccattcaccataaaattttctttgaataaatggcttgatagctacctgaagaaatgttgaaaatcatttatgtaaatcatcaagccctagagaaatgggaacatgataatgttaatgtgaaaagtaatgttggaaatcactaataatttattttatactccttttccacttgtaaatactttctctgggttttgaggtaagagtgtattaaggtttagacaaaattaatttggtgaaacatttagattgtaattggaacttgcattggggaaaaagcataatttttttttaagagaccatttaacttttttacccaggttgttctcgaacacctggactcaagtgatcctcctgccttagcctcttcaagtgttgggcttataggtgtgagccactgtgctcagccctattttcgattttttagtagattaattttgtagaaaattttgaagggatttttttaaatgctgacatttttcagttgagttattacatacatacagcaaaatgcacagatcttaaatgtacaggttaatgaagtttgaccagatttatgtactcctatgtaactatcatcgagatcaaggtagcattttcatcatccaagaaattttctttgttcaccctttccagtaattcctatgctccccttaccatcactaggaagcatccagtattctgatttttgtcacactgatgagtcttttttctgtttagctattttgttgaatatattttttcaacacagagtcatctgtgttgtttttagtagaatttttttcttttaattggtgaatagtttgttttttccattctcctgttggtcgacatttaaattatttctagattctggttattatgaataagttggtcctgtacaagtctttgtggacataatgcattttttggtccttgatcttagggagggtgcgtgtttaactactggaaactaccagccttttccaaagtggacatatcattttccagtcctaccagcgaagcctgagagcttcatttgcttttattttttatcaacacttttttttgccgtccttcttaatgcaagccattgtgattggtttgtaatatgttgtattgtagttttaaaaggaattttaatgtttttaatttctcattttttttagatcatttcaaaggtggtcagtctggattaaatctgtctaagaatttcttagatcctaaggaattaatggaattattaaaatctagagattatgaaaggtgagtttttaattttagaaagatttaatttgtagctttgaattattcacatagacttgaatattttgttttctatagggaaataaaaggatcaagagagaaggtcattagtgataaagatctagagttgttgttagatcgaagtgatcttattggtaagtattatgcttttttttaatggaagcttcgaaacatacacttaattagcataatgtaatgaaccccttgtgcaattcattcagccacatgtatccaatcttgttttattgtcatttttcttcttagagtattaaaatcaaatctcagacatgacattttgcccataaatgtcattatctttaacttcttccataattcagatattttctgtaaactggtaaataacacttgtaaatgaatatattcaagttcctgtcttagttaagaataccagtgctttgttctcatatttttcgtcataccaggaggcacatcgtatctggatttcttatttccagtgagctaagattaatcaagataatgttataaagtgtcttgtcagccttcatcctttacttaacacgatgatttattttattttattttatttttttggagacagagtcttgccctgtcgcccaggctggagtgcgctgacacgatctcagctcactgcaacctcagcctcctgggttcaagggattctcctgcctcagcctccctagtagctagtattacagtcgcctgccaccacacctggctaatttttgtatctttagtagagacagggtttcgccatgttggccaggctggtcttgaactcctgatttcaggtgttgtgcccaccccagcctcccaaagcactgggattacaggcatgagccactgcaccaagcctaacgtggtgatttttagtatcccttgaaagtggctgataagaaccattattaacttaatcattgcaaaatggtgatttttcttgttctgtcattcttttattagctgggttatttaagaactttcccttacagtttccctgagatagaagagagccaggatatattgcttcttttttttttttttatcagtttttagaataccaccttatgatctgatgcctacagtgatgaccatgaattattttgaaaacaaaaataatattttgtacttcataatttcctaattattttacaacatattactgtcgtctaggctattgattatttgtctgttgcatctgtatggtggagatactgtataatctttttttcccaactgtattccgtgacattttggtcttttgaaattggtgatggcagtaacattcatatcacggatacaggcagaaactagaaaccccagtctttgtttttaacaaaaaagggtcttgctttgtattcctggctagaatgcaggagtgcgactatagctcattgcagcctaaaagtcctgggctcaagggatcctccagcctcagcctttggagtaagctgggattataggcatgagccattgtgcctcagtttttgttttttttgagacccaattgttaaacatttacctgcgtggcactggctacagtgtcatgatatcttattttcaaatatgttgttcattttaaaattcaattctgtgtcttattgaatcaaaataaaatatattggttggaagtttttttttttttttttttaatcagatgtattttccaaacattttcttctactctggcctgtctcttcacttacttacttagtatcttctgaagagcaaaagttttaaattttaatgaatttcaattttaacaaatttttttctgttcactcatgatttttatgtcatctgtaactactctttgcctaattcaaggtgttgatattttcttttaatagttttatagtttttgctcttacatttagatctatgatctattttcaatgaattttcatctttttgcatgtcaatattaatttgttaaaaagatgatcctttttctattggatggccttgtcatccttgatgcaaataatttgatcataaatataaggatttatttctgtattctcaattctgtcccattgatctctgtggtattcctatgccagtatcgcactgatttaattaaggtagctttatgggaagtgtactttctctagttttgttctttttcaaaattgttttagatattctggattatttgcatgtttatttgagttttaactttgaaatagtttagggagaaatatgagacatacagcatcatggtcaaatctaaactatattaaaaaacaacattatgtgaggcatgtaaggactgtttaacatctgataatataattcatatcaattaaataatggagaactagatgatcacctaattagataccaaaaaccaacttgccataatatcgtaatcatcttcataatttttttttatttgagacaaagtctcgttctgtcaccgaggctggagttcagtggtgtgatcatggctcactgcagctttaacctgctgggctcaatcaatccccacacctcagcctcccaagttgctgggactgcaggtgtgattactatgtcctgctaattttgttttgtgtattttgtagagacaggggtttgccatgttgctcaagctggtctcacactcctgggctcaagtgatctgtctgcctcatcctcctaaagtgctggcattatcgaaactgcttttatttgcaagtggtctggtttgattatcttcataggaagtccaagggaatccagaatcttttaaaatagaatttaagaagattgcttattaataatatgtgtaacagcaataattgtttaataatgaaggtttttacaacagctacaaaattaacatgcctacaattaaagtttaacaatttttaacatgtttatataaggacagaattatgaaacattgaaggacgttaatagaaagactgagtaaacatgcagatttagctgtatttgtggatatgaatggttactacaaagtgtaagtcagtggtccccaaaactaacttatattcttgaatttttcttctaattaaaatcccagaatgatggctgggtgtggtggctcatgcctataatcctatcactttgggaggctgaggcaggtggattgcctgagctcaggagttagagaccagcctgggcaacacggtgaaaccctgtctctactaaaatagaaaaaattagcggggcatggaggcatgtgcctataatcccagctactcagaaggctgaggcaggagaattgctagaacctggcaggtggaggttgcagtgaatggagattgtgccactgcactccagcctgggtgacagagcgagactctgtctcttaaaaaaaaaaaaaaaaatcccagaatgactttttgtaaaacagactgttgttaaaatttatatgagagagtaataaagggccagaaccaagacagttttgaagcacaagatattctataccaggtataaagtcttattaaaaatttaaaagtcataataatcaagatggtagaattagcacatggtgtgatatattggctagaagtacaatatggtgaatctagaaagacaactttcacgaaaagctaataaatgtgaaatggaacttcaaacaactgataggaaattcctattaatcaatagatgatctggggaaatagtaattaataggggaaaaattaacttagattctcctctcctcacactgcacttacaaacttcagataaattaacaatccacgtgttcaaaacctaaatattaaaggtagaattttaacctaaaaagacaagaaaatatatttatgattttagaattagaattctttataatacagaaatcacaaattatatgataggtttcatagattttaattacattaataggaaagactactataagacagatgacaccataaagagataagagacaaaccacaaataatatttgcaacatataacaggaagtgtttaggatatgcaagtaaataaaagttgataatgaaaacggataatataagagcaggctattaccaagagagaaagaaatgtctgatgaacagacaaggatgattagaaatcagtaatacaaatgaaaatcagatttcatttcacagctgtcatgttgataaaaatttaggagactacatattgtcattgattcaaaatgtttctcaaggtaagctttttgtggtgtgttttcagctattaaacgaatcgtgattgggcctctttttaaaacgtttctgacaacatgattcaaattgatattatttattgctctttgacttgtttatcttaccttaaattcagcaaaagcgattttgactagcaaactgatgctttagattgtatgctcccaagagtctgattctagttgttgtattaagaatagtgtacctttttgctttcactgctattaaatcttggtgattaaggaagagagtgccctgtattactgtgagttttataattttggacagatgactcacttctcataacatcatattggatgtttcttttacgatttcttcttcttatacttctaaaatgtacctgttttaatgtttttcccttagatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatga

SEQ ID NO: 1741 - DNA, 152509 bp, Homo sapiens
  source 1..152509: mol_type = genomic DNA
gcggccgccgccatcagcagcgcagctccagggccggctgcagcggcagcggctccgccgggcgtcctggcagcaggttcggcgcgggctccgcggcgggggcgctgcagctggggagggcggcggggcggaggggggggggggcaggagcacatcccttcggcgggcggggggcgtgcgggcgcgcgtgtgtgtgtgtgtgtgcgtgtgtgtgcaaccgccgaccttgcagaggggatggctgcgtgcgggagacccttggcacttctgggcgccctcgccgcgcgcgagccgagcaggtacagagggacccagcctccccagccgccttccagccgcagacgcattttgcaagagggtggggggtgaaagagaccaggcctcggcatcccaacctcccggctttgtgggtttctttccctttcgttctttgctctaagtgcctgtttactcccggccacctgggtagtttctttccgggttgggagtgcgcgccagctgcagttgggaagggggcggtgggttggggtgcgggtcggctcgggctcgccttggggtcgggctcgggaaggagttgctggctggagaggggagggggcggcggcggagcaggcggcgaggaggagtctcagggctgccgcgctcgcctcatctcgtcctcctcctcctcagctctctgcatccactccaggctccttcctgagctggcacttccattccccccctcctcctggcatgcgaagcgctttgttcagtgcagcgttgcagaggggttttcccaggctccgccctccacattcattcatgttttttctccttgcaactgtctttacgctttttgatcgtgtcatgtttttgctccatgtagtatttatttctttcccgtaaaggaacggtttatcactcgtcctagtcgctacaatgctgctgtctttggaaatacccacttccccccacaaggatttaaatatgggatggacagctagggacagtgggtaggcaatgaacggggtagcagaaagcctttacggacagggaatgtgcatattttacatttatgctccggatcccatgggatcacatgattggattacagtcagagttcacgctttaaaaacttccaaatatcgttaccatttaaaagctttaagtttaacaacgaacgtagttaagcattcatgcaatttatttggttcagctgtgtctcaattctttattgaatcagaaccttcctgaattagatagtggatgtttctttagagcaaggagctgagaaaccctatcttttatagatcacttagcacaatgctagatgaaatacttagaccatcatttttttttgtattattttaccatgtagttaaaaattgcaaataattttgtgctgagctgacatacagccagatcagggataaaatactgaagttaatcgtggccttctttaccttctgtttctttgctgtaatgaaaccataaatttctaaaaccttatactgggatgttagacacattccttcccatataggctttcttaaggagaattaatagttcagcgtttttgtgtgacaggcaaagcgtctacaatgtttagtttagtccttataacaaccttctgatgtggataatatttcctaattttacagttgggaaatctgatcttcagagaggttaagtaacctgaacaaggccacacagtaaggggtaaagcctggctttgaacccactccggtttgacaccaagataagtcgtcatgacttgctgcgcctcttgaaagaaatcctgaaagtagatgttatcagctccacaaaataagcactggatataactgagtcatgcagtaccacattctttagttgtttatcttggacaagttacttatccaatttttttttaatctgtaaaatgaataaatgatagctaccttcttagttaacagattaaattagggaatgtgtagaaagtacacaggcacatagtaggtgctcataagtgttctcttgtcttctacagtaccactaataacaaaagctttaagccttccttactgttctattcttgtgtctttgcttaatgactaaacattgtttcatgtttaacagtgacagtgggctttgcttctcagttttcttgcagtaagttaaaatttcagctttaagatccttgagaatcttgtggaagagcctgaggtggctgatttggggagataggtgattcggttttgggtcattcttatcttggcctattatatttcagatcactgtgttttaaaatctgtaagtcaggacaggctaggttgtgctgcagtaacaaataactctcaaacctcacttatttaagcaaacaaaaaggtgtttctggcgtatgctgtgtgatcacgtgggttagccagagctgactttgtggtggtgtcagatttgctgtctggagcagtgctgatcccatggcagagagagaagagctctggaggatcatgctgtggtaataactaaatgctccagcctggaagtgaagtctcatccgctcacaggtcgttagctacagctcctcacacgttcctgggaaacacagggaagcagaaagtgtggtcctaccatgaacctagaggtctggaataactggagtagccacagtagcaaccccttgtattaactgagttaactctaaaacaagatgaacaagacattgtccctgcccctatgaatgggcagatttactatacatgcctaacataatccttttgtagcctgatgcgatactttacttgttcctggtattgttgttttaaaacacaaagtgagtttttttactcttgtctgataaagatacggtgttttttttctgttttcttaatgagaagtcccgatactgacaaaatgacctctgtttaattaaaagttagtaatcttttgcagtggtgcccagcttggttactttttcttgagtttaggttagtgctctgctaggcagtaacttttaaagtatctttctcctctgaaggtagtaaaatgtgcttctccgtttttttctttttcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagaggtaaagcattgcattaagtagaagtaaggcttgctgtaaatcttttaacaaagtatctctttggtgacaggaatggccgtttgttagatgttgaccctgcctggtgaggagcgctatttctcttgctcatttccagcagtcctgcacaattcctgtctctcaggagatacttaataaatatctgttgaatgaatgaattgaatttgacgaaattacagtgcattccttccaaaccattagatggggtattaaaggctgaaagttgctatttgttaataggaaccatatttgggtcaaggaatctgaaagtaatggttaaatattctttgccaactggatcattaagaattttatgtttttttttcactcttcctccatagttcttttgaggtttatttttgtaccactccatcagttagattaacaagataagaagtgaagagaattgtaggcattcactcagaccattacttgcagaagtcagaggcaaactgagttattttccacgaagaagcagtgggtcacaaatatatatatgatacacatttcatgcaaagacagaaaagtgtgtgttttccatcaaccgcgaatacttttaatagtagaaaagtaagtgtattctagcttattgtttaaaaagatttgtattgttctcgtgttatatcaatggtgaatagcaattatcttttatattaaacttcaggagataagaatgtagtagtgctaaaaacaagaactattaaagcaaataattccaaactgactatggtgttttatgaaatatttaccattacagaaaaaaaattctgaagcgtatgtaggggagaagtgacttaaaaatcaaataaattaatttgaaatgttttttggtaaaatcaatttggctagtcaccataaggtgatctttgaaaatgcagtcaattttatggcctccgtgaatctggaaatagtgcttgtttcctgtctagaaatctctgttgcctcaggtggatgcctcagcctaagttcaaattgatgattgtagtaaccagtgttcaatgaggtggagatttacatgagaacaagtgtggtgtgtggaaatctgattttttatagtcatatagaaaacgttgaaaattgaatgtgtttgcccgtccccctcactagaatctgaactccctagagactcactctcatttgttactgtaggaaaagcctccagacccaagggtaccagctgaggtgggcatttggagacatgggccctgctttatctgtccagggagggcaccctgttctagtttgcacaagtgcagcatacagatgagcagcagccctagcccagcacagttcctggcagctaatggcagcccaaatatttgttgaaggaacgagtgcatgattgatctgaaggtgttatttattaggccataagtattaaacatttttcatatttaaaatatatgttcataacattctagataaaatgactatcctgagaaacacagatttacaggccataggctcttttcctttctgtatcaaataaatgttcaactcagcacatgtttgttactgtgtctggaattggtgggttcttggtctcactgacttcaagaatgaagccacaggccctcgccgtgagtgttatagctcttaaaggtagcgtgtccacaggttgttccttctgatgttcagatgtgtttggagtttctttcttctggtaggttcgtggtctcgctggttcaggagtgaagctgcacacctttgcggtgagttttatagctcataaaggcagtacagactcaaagagcaagcagtagcaagatttattgcaaagagcacaacaacaaagcttccacagtctgcaaggggacccaagcagttgcaactgctgcctccggcagcctgcttttattctcccgtctggccccacccacatcctgctgattggtccgttttacagagagccgattggtctgttttacagagagctgattggtccattttgacagggtgctgattggtgtgtttacaatccctgagctagacacaaaagttctccaggtccccactagattagctagatacagagtgctgattggtgtatttaaaaaccttgagctagataaagagtgctgattggtgtattcacaatcccttagctagacataaagtttctccaggtccccactagactcaggagcccagctggcttcacccagtggatcccgcactggggccacaggtggagctgcctgcgccttgtgcctgcactactcagcccttgggtggtcgatgggactgggcgcctaggaacagggggcagcgctcatcggggaggctggggccgtgcaggagcccatggcgtggggggtgcttaggcatggcgggctgcaggtcctgagccctgccccacggggaagcagctaaagcccggcgagaaatcgagcgcagcaccagtgggccggcactgctgggggacctggcgcacccttcgcggctgctggcttgggtgctaagcccctcactgcccggggcctgccaagcccacgccaactgggaactctagctggcctacaagcgccacgcgcggcccccgttcctgcccgcgcttcttcctccacacctccctgcaagctgagggagccggctctggcctgggccatcccaggaaggggatcccacagtgcagcggcgggctgaagggctcctcaagcgcggccagagtgggcaccaaggcggaggaggcgccgagagcgagtgagggctgacagcacggtgtcacctctcattactaccttcatgtacttcatgttcttatgatagggataaaatgataaaacacaggtctcgaaagaagaatggagttgaagagctgataggtaaacatgtaactatgtactatggtgagaaatgaatagtatggagattccacagagatagggagtcattattttgtccccattgtagggggcgcagtttggggtgaagcagaatgatgatttagggaaggaaagttaacacctggatttggttcttaaggctgggaagttatctgcgaagctgacaaggcaaagtgagtgcatttcatcctggggtagcaggttgtgaaataacttggggactctgagcaactttaaatggttctctacttctagagcataagaagttctcttcaggagggatgagaaggagacagagaggcaggatactggagcaggagaatcaggaggaatcagatcaggaaaggccctcagatttaagcctacatttcatatgtagagttaaaagttttaataagaaaacttgcttctttaagatatttttaaagttttcaaagagaacttggaataaattgtgtctgacttgtctgtgagcgtttaggaagttgtttgactaaggtagttaagaactcacagccactaaagaaaagattggaatagattagctctagtaagcacactaaagccacctcagtgggacttctgatggggaaggggaagacttcagggaagcggcggcttctgagccagtgtagctcactcagcagcgggggacgggagtgaagctctaggtccccatgggaaaccctgagtaagcaaagggacagaggggttggtgctcggcggtgacacctagaaacttccgcgctcctcacaatgtctgtaaggactcgagccctgggaaggatgtgggggttagagtaagcaggtaaccatcagctcctgagattaatttttgagcgtatctttaatatctcattgtgacagtttggaatatcaggtttgttgtgccctacctgtgatccactgctttgctttactagaagacatctctaatgcgatgagataagaaatgcggggagaggaaattgggagaccagaagaggagtcacagcccagtttgcccctactgtttctgccgtcagctcaggagctttcaggaaacccatcgcctctttttaggcttcctgggggaaatagtctgaaatgtttgtcttgtgcttggtaatcaagtccgtattaaaaggcagatacctgatactttctcaaattatatttttcttatgcttccatggtagtttcacctcttagaatgtaatctttctttgatttattcttggttctcctgctgggacagatatatccctacggatgtgcaaagccacagggtaacatgtatctttcaggaatgtgaattttacttggggaaaaatacgtatacttgtctgtgtgtgcacacgtatacacatattaaagtattaggcaagcataaaaatgtgcaataccggaatctatcatggaagagtatagaaagtttgcatggatttgaaaattaagcctgcatagactgcttttataaggagatggagtatctacttctttgctcttagaggttgtttactagaaaaggtataagaagaattgttaggttaagggcaggaaacaaattggggacataagtgagacagtgtccgacttgatgggtgatctgtatactgtgtaggactgtggttttgttgaattcagtctcttcacccttggcccagcgttaaaccagatagaatcagttctccatgcctgtttcccatctgcaggaaacgtggtgggtgccgttttgacaccgacctatcctttgtgaggttgaagaattttggaagagcatgagagcagcacttggtgttcagaagaaaggcttagcatgttgtcctgggttccgtggagaagggtcactggactgcacggggtggctcttccgcatggtcttggtgagttgacagcagggcagcgctgtgtctcccagccatcattccttactcatcgctgctctgtggaggggttatctccaccaccttctcaggccttcgcttggacccttgagtaacatggaatggaggagttggtgacttgcagggggttccatgcctcttccgttgtgataaagggctctattcgtgttttgccactcattcttgtgaatgtgtttcaaagctttgaaaaaaaggaaaagaggtgttacttactttagttgtatttgggcctagggtttcagagcttcatttcctttaagattggaagtcagtgtggaaaatactaagtattaaccttttgcaaaacatgttttgaaaatttggtgtagctgtttttcatttttattggttgagttcatttggctccgaacactctgcaaaaaatgagaactcttttcctgtctgagaaccagatttctttctttctttcttttttttttttttttttgagacggagtctcactctgtcacccaggctggagtgcagcggtgtgatcttggctcactgcaagctccacctcccaggttcaagccattctcctgcctcagcctcccaagtagctgggactataggcgcctgccaccacgcacagctaatttttttgtatttttagtagagacaggttttcaccacgttggccaggctggtctcaaaacttctaacctcaggtgatccaaccgcctcaaagtgctgggattacaggcgtgagccaccgcacccggcccagactccttaaaatgtgagaagtagcactgaggaatgtgatcagatcatggccttgattgacacatggggtcgctttccacggttggccttcttgttctccacggcatcttgtgcatagccatttgccatttcaggagctcagcatgcacatccggtatttctgtgcttggttgtctttctggaagttacttcttctccttttccatttctactgttttcttactctgtatgggagatgtctctgctaaagatttcacctctgagttttttcccccattttctgttctcttgtcagatatcctcctcccctccacagacatgccctgggtctcctttgcttgtgtccacatgtgccttcttgtacttacaatattacatcatgatcattcttctccaggtctcttatcttagcgggattataatatgttagaagagaccattttggtcatctgtgtgcaacagaagaatatttggttgtgttaactttttgtttttgagacggagtttcactcttgttgtccaggctggagtgcagtagtgctgtcttggctcactgcaacctccgcctctagggttcaagcaattctcctgcctcagcctccggagtagctgggattacaggcctgtgctaccacccccggctaattttgtatttttagtagagactgggtttcaccatgttggccaggctggtcttgaactcctaacctcaagtgatccacccgccttggtctcccaaagtgctgggattacaggcatgagccacttcacctggcctggttgtgtcaactttttagcaaactagagggttgagatgatttatactcagggaatttgtttacatttttgaacctcgagtaggaaatgcttcttccaatatttggtagcttctgattaaaaacttgtgataattttaattgcctgaacagataaaccaggtggttattgttaacttttgttttatatgaaattttacttcacatacaggattttttttttttgagacggagtttcactctgtcacccaggctggagtgcagtggcacgatcttggctcactgcaacctccactctccaggttcaaatgattttccttcctcagcctcctgagtagctgggactacaggctcctgccaccgcacccagctaattttttgtatttttagtagagatgggatttcaccattttggccaggctggtcttgaactcctgacctcgtgatccacccgcctcggcctcccaaagtgctgggattacaggcatgagccaccgtgcctggcccatatacaggatttttatagcttatccatttggtacatttaattactataaagacaaagagtttggcctcatgcagtcactgacttgctatgtggttggtttccttgtgtgtaaaatggagatgatgtgtgaagatgagatgatatggcaaatgtaagcatttgccacagtgcctgacacagggtacacgctcaatccagagagctactactttctgtaaaaaactggtttatgtcagactccttggttccatatgctttataaacacaggaaacaggaatatctacataaaatctgtaaatgcattttaggcttctcatgtgctcaatgttgattactgacatgtcccattcttgttctgactattcaaaggttgggatctgggggagagaggtcagtgcagaaaataatttgggaatattcttaccaatgtgctgctccctccatttttccacttaaattcatttaagccttgcctcgttttttgacagtgttagatgaggttaaacagaatatttgtcttcacttagttctcaagaaacagattctgagggcttctgttttattgttgaactcttttaaaaaatgtcggtgtcacagatcacgcgggattgaagtgaagtgctctccttaggttccaagatggcagccatctctctgtcccctcctccgcttctgtgtgacacaagagaagcccagccggggtttcagaattaatctgattaagatgaatgttttcatttgctatcaattgtgggcctactccagtggttattttacaaagtctactaccaggaataaaatcttacgtttacttgttatgtagggattatcttgttgagctgataagtggagtaggtttaattttgatgattttcagatggaattccagctgtttaagcatcgtttttcacatttgaatgttaggtcagcagttccatgctgacagccttaagatttgagaaatcaaaaatcttgtagtggaaacaaccccatggcttatttcaaaaacaaaaacaaaagaaattctctatattgtagctagaaaggaaataagtaataatttaaaaaatagtttttgttaatatgggtgaaaaagttactaggagcgatcatgtagatagctgacagtgcttagtttgaggaggataaaaatatgaaaatggagttaacatagcaagcctcctttttttttgcagataattatttttcggctcatgttgagagcttatttgatgctttctgaatgcttattaacgttagccaaatgcttctttttaaaagcaaatacaaaatgtagtaatatgattaaccagagtaatgattttattttagaacatttttgtacaaaatatgttctgatgaggtacaatcttatcttaccatagaacggaaaaatacataatttgtgtaaaatctcctatcatagaaaaacatttttaagcttcacatttaaaatggtgataatttgagcaagtctgggctaaagttgattcttgtattatgcagaaaaatattttatgaataaattaagtgctttactttttcatgtacatatttaactctttaaaaacatttttgcagtactcttctgcatattaatactatgctcattacaggtgatgctgttatactgttaaccattgttcactatagcacaaaaacttataaccaaagagagacctttcttctcagtgctcaagtcattctttgagaaagaagctctttttgatcatgaggctttaggcttacatttggtatacagttgcattgattttgatttttttttttttttttttacaattttaatgagaagttgtcaaaaggtttttagaaattttctatgatgaattttgttctagaaaatattctaaggctgtgctgtgatgcaaacatattgaaaaaatagaaagtgataacaaaacggttggctgctgtgtaatgagatagcagtccctaagcatgaattggaaccatacgatttaagagttacacctacttaatacaaagcttgatttttatggtccttatgtgtttctgtccacagaatttctgtgtgcctgtgtgactagagtatgaatttaaccaagcatacttgttattttgtactttgaagtgtgcttacataggtttatcttcaaattctttcagatttgccagtgaagaaaaagatagggtgagcatacaactgcttaatatagtatccagatggaaataggttaaatatacaattagggtggtatttgatagtttaaagataaagagaaaaataaactgggctgatacacagggacttggaaggtggttggttaagccacgccaggagtgaaccaaggctctcccttgtgttgctgggttcttgtgcgcctctctgagagaattacacattttacagcaggaaggatggaccttggaggtcatttagttcagcctcctcattctgcagatgggaaggcccagtggcaagagggaggtggttttatataggtcttacgatgataaaaagggcgaacctttccacaggtctctactaggctctgttcagagggcttttcatgttttctcatttgattcctacagctacctgagacaggtacttttatgattcccattttatagatgtggaaatgaggcacagaaagattgctatttgcccagggtcacatagctaggagtctgcagtgcttttgcttctaaccatcatgcttatacttgctgatgttgatagtagaaagttctttcctgattagtaagagtttagaaatgctctccatcccagttaacttgctaagcatagcacacagagctgaggttattcaggaggtcagaatttgaaggattttttttttcttaagcctttaattgtttagaatctatttcaagttgtatatgtatatattattccaagttagatttgctatcacaaacagtctagggaatttccaagctctttaagagggaaagaatagttgtctcatccaagacgtttgcttacatgatttgcttaattttatagttggaagtagagatgttttacttaaaatggagaatggcagtgtttaagtgggaatctccgcctaacagttgaaatttcggacctgaaggcttagaaaatatttctggggaaactaacgtgaaaacattaaaattctaagcaaaataaagtagataacattctataatttgtcttcatgtggtaggtacagtaggatatggaaaaagcatgctattttagacgtatgggcactcttcttccacactgcaggtaaagggcaaataaccatcgttggccaagctcgatggctcacgcctgtaatcccagcactttgggaggccgaagcaggtggatcacctgaggtcaggagttcaagaccagcctggccaacatggcgaaaccctgtccctactaaaaataaaaaaattagctgggcttggtggcaggtccctctaatcccagccacttgggaggctaaggcaggagaatcgcttgagcctgggaagcagagtttgcagtgagctaagaccacaccattgcattccagcctgggcaacaagagtgaaaccccatatcaaaaaaaaaaaaaagaacaatttttaagggatcatagagaattctgtttgtcttccgggagcagtgaaaatgctagtaggctatgcctagacaaaaaatcttgtacctgccctcttagagtttttaatacattgtgtctccaaacacaggaaaataaaagatctaagagcaacataaaggaacaaatataatttcaggctagtatgtgcagtatggaattccccaagggaaagtggagcaaaaaataattggagtggagtaaagcaatgaggaaatacctcgcggaggagtcaactttcttcttaactaaaacctgaatgaggaggagttttgagacgggtttttaaagacaggaaggatatattggcagagaaagtaagttgtttttagactttggtagaagaatgaatgggggaaaaattacgcagaagtgattgttggtttagattgcttggttagagtggatttcccagtgaacttgaaactctaaggaagaaaagaggaaaggaaacttattagatttaatgtgtttggtttctgtttatggtaattataaaattaccaggtcaaggtcttttatactgccaggtgggtcataaggtcataagtatttaaagaagatcgttcggtggctaggcagtatcttttatgttaacattaaaaaacaaccttcacccaaggtcagtatgatttgttgacacccaggaaactggtaacagtttaaaagaatgaggcagccattttttattgtttttcctatttcagaagatcatcatgtgtatgaataaaccagcaaaagagtaatatggctttgagcaaatatctttagtttcttcttagagaacaaggtggttaggggttggtaggggtgatgttgatctgcaatttactttttagttgtaaatggctgttattctagggatcagtaaatcctgactaaatccaatcctccacctgtttttgtaaataaagttttatagaaacatagccatgcccatttatttacatactgaccatggcttctttcatgcaacagtggcagagttgagtggctgtttgtggtcacgaagcctaaaatatttactatttaatgctttacagaaaagtttgccaaatcctgcctgggaaatagagagttaacacatttatttgtaaacccttttctgtttgggaataaatgagaatgctttatctttctgtggaggattgctgtaggaatgaattattattaggggaacctaggtactgctttagttagtatgtgagggtccgctgcctgccaagcataagggaattcacatttggttgggaagaagtccacttacttgtggttttaaaatgaagggaaagccttagaggtcaagttagtcttgccagaaatatttagttcttgattttctgataccaaggtcatgggtctcaacccaaaaggattagattgttagggagccacctgttgagtcaggtagcgtactctccttttttaaattgtactgtctccatctagtcacctttgtatttaactcaacttggtagaaaactactgcaggcaatccatttccaatgctgtacatgaaacgtcttgtgaaggactgttattcagcaaaatagagctgtctttgagaggtgcgccttctgacaaatgagccctacaaggaaggtcttcccctgtgagtggagtgccaggtcttgagaatgggaccaggtcatctgagtgattgataattgctgctagcacattaagcattataatttgtccttaggttgtgggaaacatgtttaaacatccaatatgtttgaattctcagtagtccctacaacactttctgtaatatcctaataattctttttttctggtggttttggggtagtgggatgagagtaagtaaatgatattttcgtgttatggttttgttttaatttattttgcttaagtttaaatttaaggataggctcagttgagctcatgataactgttgagttgtttggggaatactttggaaagcatgttaattctccacagatgaattggatcgttaacctctttattttggtccatgctggtgttagcacgtggctcaaaatagtatgagaatcggtaactgttaacatgtttcctttcccagcgacaggaagagcccatagtggtcatgaagtatggtggaatcagagggccactttggtggctgtcacttataagcccgtctggacttctgtggcccggctctgaggtgttggacatgttgtggagttcaccacctctgtccctgtcttccaggaaatttatagttgaagacataaaggccataatggcttcacgtgaaagtctagacagctgtatgaatatttgatgagtgagcatataaggaaatactcagttaacatatgtaaggagatgtatgactgcatagccaaggggttaaatgctttatttatccttctgtatgttgacagtttaggttgatctatcatgttttgatggaattaatgccatacgtgtgatgagttatatattcagcattcatgttaatatcttcttggaagagctagggtttgcaataagttgtatttgatggatatgctccttcatggaaagattacctttttcagtctccagtttactgccttagttatactactgtatactgtatttgttttacagctttattaagacataatttacatgcaataaaattcacccgttttaagtgtatgattcagtgtgtttagtaaatttatagagttgggaaacctttaccacagtccagttttagaacatgtctgtcacccccaaaatttccttgagcttatttgcaaccaatccttgctcccactgtcagctgcaggcaattgctggtctgttttctggctctttacatttgcctattctggacatttaataagtagaatcatacagtatatagtttttacatgtagctttttttcattgtttgagattaatctgtgtcgtagcatgtatcaggatcttccttaccttttatcgctacataatattctcttatataaatgcactgattgtattgattcattcactcgtttgatggacatttgtattgttttcagtgtttggcttgtgtgaataatgttgctgtaagcaatcccatacaaatctgtggttacatagagtgttctagaagtctcaggtcaagctggccattaacacctattttacttgatattactatagagactagggttattgtttgcatggcatgtgtgttcctgttctttcacgttgaactttttgtttctttgaacctctgccactgttgcaggtgtgtcttttgtggacagcgtgttgccgcgattgctttttcatccagtccgacaatctgccttttgggtgggtgtttattccatcacattgatgtaatttattattattactgaatttatatctgtgattttgccttttctgtttgcttcatacttttgttcctctgtacttccttaattgccttcttttgtgttaaattttttagtgtatgattttgatttctctttcttttttgtttttactatacttttgattaattttcttagtggttgccctagagattataatatgcatcttaaagtatcactgcctacttgagagtaatactaactgaactctggtaaaatatagaaacttttctccagtatctccttttctttctccttttatgctattattgtgatatatgcttaatccctttatattataaagcaggttacacagtgttaaatcactcctttacacaatcttttttaaaaataatttaagagaagaaatgagaaacatactaataggtcttacatatacctacatatttattgtttctagcactctcctcttcttctatggattcaggttatcatcctgtaccacttttattcaacctgaaatatttcatgtagcatttcttgaaagtcaggtcttctagcagcaacgttgcttttttaatatttatggaatgtctttatttttccttccgttttgaagcataattttctggatatagaattcttggttgatagggttttgttgtttttctttctgaactctgaacatccactattctctggcctctgttacttctgagaagtcagctgtttattgtgttgtgtttgttttctttgcaagatgaattgtttctttcatggttctttccatttgtttctcatctttctccaatttgaatgtgatgtgcttagttgtggatttctttgtgtttatcttatttggaattttattgaacttcttggatatgtagatcagtatttttgttttatcaaatttggggagtttttggccattatttcttcatatattttttctgtacctttcttttctctaatcacacatttatttttatgtttgttgttccacaggtctctgagggtctgttaatatctctttaatttttttctgttcctcagattggatacttttcattgagctatcttcaaatatatggattgtttctcgtaccagttcagatttgcggttgagtccctctagtaaatttttcatttcacttactttacttttcaactctagaatttctatttgcttctctgtctctttttaaaataatttctatcactttattgagattctatttgttgttataatcatactttaattctttaaatatggttcccttcagttctttgaacatataatagctactatgaaatctcatcctattaaatccagcatttggggatactagagatactttctattgactcaatttttcccctgagtatgggtcacactttcttatttctcttcatgtctccaattttttgttgaatattttacatttaagataatagattgtagcaactgtggattctgatccttgctcccttgtgagttattttttggtttagtagcttttctggactaaatatgtgaaggctatttctctcatgttgtgtggctgctgatggctctgcccaggtttgctttcgtttgtttgttttttttgttttcttatgttttactttaaatcctagcttcctagagggttaccctgtgtagttttgttttaaagccaaaggtagatcagagcttaattgtgagtcagtctgaaccttgactctctgcctgtgggtctgtgtgtgggctggggagcactttcaaatcacaggcagttctcacatctgtcctggctttaactttcagctggaccctcttatgtcttctttgtgtgtgtatgcccaggctctgtggcccaggagtgtgcagaggttaggagactgccctagtgttggtgacacatgtgcagagtctctggttaacctgggatacatgtggagagtttacccagcacactgtaagtggctcacctaccagaactccctagtaagtccctggctagtcttctagtctcttgcttgccctcagcaggacctcagcctcaggcggacattgccattgattttcttgagttctcttgctattgggattgccagtttaactgactgtgctccaaatctggtgaacctggcctggcaaaagcagtgaagttgctgcttttcccagctttcccctcttggttgaaccctggcactgacagaactgggatagggagacaggaacagccccgggcaaaaaatgccaatgtgctagtcttacctgcagttcagtactttccacgaagaaatgcccctccacgtgtatacggctttgggtgattgccagagcgctgacagtggtggttcttgacagttttgtgtggctttatggttgcgttttgtggagaggatttgtcactcctcactttgtccttgctgcatttcctatgaatgtgtaccattctgtcctcctgtggaccgtgaatgtggaccatgctgtcctcctgcagcaggcagtgtcctgggccctcataacatcaagttgcacagtgtgttttgacaggcctcttacttaagactgcatgtagagacccatcaagctggcagaaaatctagatgctttttaaaagatacaaatagtgtgatgattgtgtttttaaaatactgttgcaggcattctgcatatttaaaatccctactactgatgcaaatgttagttcactgataacctttttttttttttttttttgagacagagtcttgctctgtcgcccaggctggagtgtagtggcgcgatttcggctcactgcaagctctgcttcccggtttcacgccattctcctgtctcagcctcccaagtagctgcgactacaagagcgccaccatgcccggctaattttttgtatttttttttagtagagacagggtttcactgtgttagccaggatggtctcgatttcctgaccttgtgatccgcccgcctcagcctcccaaagtgctgggattacaggcgtgagccaccgcgcccggccatgataacttttatatttaaacttctataactgaaagtgtggtttagtgggggaaaaaaagcaagagtttggagtttagagttgtgggattgggattgaatcctggtacaacttactaggtctgtgattgacagaatgttacttaatctctctgaacctgttttctcatcctaaattggatataatattcctaccttatgggttattttgaaaattaaatataacatagataaaactggtacttagtagctattcagcaaacgtttgtttacccacccagaaagtttgtggttgtgggtgtgtttttggcaactttttcttcaccagatttatcttcttgctttacctagctttgcttcttaacgttttctcctttttgtagaataattttgctattttatatactaactgaaacatacagtgtatttctttcagggtacattttggttgaatgctcttcccagatatccaaaatttcccaacatttcatagtgatttcctttctaaagtataaatttcatgtgcttacaagtgatgatgaaacttcactgttattttacggtgaatgaactcatatgtagacggtccctgacttaaccaatcgtttgtcttatgatttttcgacccatacaaccattctgtttttcactttcagtacagtattcaatatgtgagatatctaacactttagtataaaagagcctttgtattagatgattttgcacaactgtaggctaatataaatgtgctaagcacattgaaggtaggctaggttgttacaatgcttggtaggttatggtgtattaaatgcatttgacttatgatattttcaatttatgatgggtttatcagttcatgaccccattataagtagaggagcatgtgtgtgtgtgtgtgtgtgtgtgtgtaaaagattatcaggtggaacatctgtacaatgagagacagtagcattgttatgtcgacattctcaggccatgattagaaggggcaaagcaaggtctctaagagagattatcaaagaatgtactgagaaacgttcttgaaccttgctggaccacagcccactctgctcaacctcagcggttctcttctgtgatatttaagttaatatggaagaagtggtaactttggttacatcaggttttaatgtcacctttagttttggggtggacacaactggactccagtatgtccaaaccctcttaataatactatattttcatagagtttttagaactgagaattgtatagtttatcttactattttacttactgacagagtaccttattctagaatactttttaaaaaaatattaagtttttaaaagccaaatctctagacacttcttgttccttggaaaccttcttgtctcctgaagagtacatttgttgtggatagtgtgttcctcaagagtaattcttaaactagttggataggtttaaatttcgcaacataggcattgcagaatttagacatacaggaaatcaggattcagggctcatttgttgtaaggtgaaatcaggaagtctctggttaaagattggatgggattaagcagacgttttgtaggcagtctcttcaccctgaactgcagccgtgtgctgtctggaatgcggtctgacttaataacccacccatgccagtaacatacatgatagagcagaattgctgtagttaaataatggattttataaacattagatagtcttttagcacctgcatttttttgtaagagtcaagcaagaagttatgtatgtatgcattttggtctgaatcttgtacttttgttaaacactgatataaatgtgtctcttgaggctggtctgtaacagatttataaaaatgattactgtttcttaggctttaaaaatcatatttttggcaaccgaatctatgagttttattaagtaaaagtttagaccttttattctttgcagattggataatttttcttgtacacttagcaaatgtttgataaatagccctgcaaggcactgtgcctgctgagtgctgtggaggttacctgagtgactctggcatacattgtagcctcagcgaccctgacgctgcagttcaataggagagttaagacaagcccaaaactgtaacagctgcaaagtgataagggctatggaacaatgaaaactgtcaggagagactgggaaaggagaacagtgttttctgattccatgtgaaagctaccccctcaaccccaagaattctctttactttctgtgcccacattgagctaattctctaagtcccagtttcgtaaaacctatgcatgtatttctgatttcttctcattgtgggtacttgaaagagaggaaaaaggaatttggggtcagagacttgggtaaggagagtaacctggtcaaatagtgtggtttcttgacctgggcgttgtaccaggctgtgtgtggcatcctgatctgacatgccactgaaacagcctggaagtgcaggatctcaacgaaaatgtagttggaaaaataatgcgggtaagcttggggctggcagcatgttagaattgggaaaaataccatttgtgtaaatcaagcgcttggtaccagatgtatgaagagctactgacacctcatggatgtggatgttattatttctggttacggaaagtgtgtatgtgtatgtaccaggatctatatatggtgggtatatgcacatggtcttggctaaaattgatctatgagtttaatctgtgacagagaaagctgttcagtatattcctcagttgcttgaaaataaacttggagtgtatctgttcaggagtcacagattaatctttctaagtgtatcctgatttgtctgacagaattctgcagataggacttactggaagtgaagagcaggtgtcatgtaaatgatgcattatctttttcaagtttagatgcatactgtttgaggaaaaaactgcaagcatgctttttcttcttttttaatgaaataagaatagttcagagtggtggagtgtcaggacccattgataggtgggtctttctagaaaaatctaatttcaatgaaaaattacacatagtacattttgctttttatgtattccttgtactctgaacctgtgtgtgtatatcagcaaaatttgttgtttctgaaatgtacttctaaagtgaatcttattttttaacatttaatcgttttagaattatttgtatacccacataagcagatacataaacagggaaggatcttttaaatatgatgttgggattaacggagtggatgtttggaggggaaagtactgaaattcatcccacaaatcaacatacattttcgagtagatatgtagaaaatcaatatatagaaagtaggaaatatagaaaaacattgagatttcattctagggcttagagaattacagtccagaaacaaaaagcatgacagatagaaaaatataaactgcttatttcagaactagtatgaaaaaggtagccttttctaatacgtaagaaaaggtacaataggtaaatggacaaagggaattacaaatgctaaagtattatatggaaacatcgttctctgtaataagaaaaaatggaaacaatgtggagacaatttttatttacccacgcatttgctattttaaagaaatggcacccagggctgctgaggttgtgtggaacaagtatactcatttattgctgatgacatagtagagctttaaagggttttatgtcttgaaatttatcctaaggaaataattcagctgaagcaaaaagatatttgttcaaagagcttgattttggtgttatctttaatagcaaaacagtagaagtgccttaaatgcccttcagtgcagactaataaattgatcttatgctctggcagacattaaaaatgataatttttgaaatcctgtggaaacatgaaaaatgttcattatatgtaaaaatccacgtatgtataggatatacaattgtatggtctttgtggaaatacttttgttagggtgacagcaacatgagaattttaagtaatttcaggcatcaattgagcatttaccctgtgactcttcagttaattcatcaatctgtgttctgagcactgctgtaggctccagggatgcacagccccttgggtgatctctgtggtcctgtaggcggacacataagcagctaacaacacagtatgaaagagcagctttctggctgagtgctgtggctcacgcctgtaatcccagtattttgggaagctgaagcaggtggatcacctgaggtcaggagttcgagaccagcctggctaacatgggggaaccccatctgtactaataatacaaaaattagctgggtgtgcgtggtggcgcacgcctgtaatcccagctacttgggaagctgagtcaggagaagtgcttgaacccgggaggcggaggctgcagtgagctgagattgcaccactgcactccagcctgggcaacagaagattcatctcaaaaaccaaaaccaaaaacaaacaaacaaaaaacagccctccagagaagatggtgtggaggctgggtcttggagaatgaataggagttggccagatcatttgggtggaggctggctgaatggaggcaaccatggaaataaagtagtgacgttcaagttttggaggatgtggatatttacaaggaccaagttatctcagggtgaccttaacagtcaggagcagtgatggaggggacggagtgggtgttgaggcccgggtcttggagtgggtgggtgtatatcgtattttggttggaagaggagtgcctcattttcacttcttgcaggtttttcatctttcaaagttcagtatgtattatttgtcttgttaatcatgccacattctcataatttttgagcaccttttttggttgcctggctatttagtaaacataagtgtagaatcaaaagagatgtttgtctgtgtcagtttcttcgtgtgtttgctactgtggtcattcatatattgatcagcgatgattttcctgagaccgtttattgcattggtggcaaaaattagattttctgactcccaatctgtgaaaccatattcctttctgcattttattgctggactgtaggttatgttgaatataaacatatttgtggataatgtagttgtatgtggctgagaggttgcactggatattatggaaaagaattttgtatatgaaatagatagtagcagtgagtgttttcctgttttctttttaaatgttcttcaacagggagaatgaaatctaaatgataattctgtttattgttttttcctttttttttgtagggtcttgctcttttgctcaggctggagtgcagtggtgtagttgtagctcactgcaaccccaaacttctggggacaagctaaggcttgtccccttcctgctttagcgtcccgaatagcttggactacaggcacatgccagtgtgcctagctactttttttttttggcggaggggaggggagttcctcactttgttgcccagactggtcttgaactcccagcctcaagtgaacctcctgtgttggccccccaaagcactgagattacaggcatgagccaccgcacctagtctgtggtttttcttcttcttatttttaaacatcctgtgcagaaaaaaattaaggaacctgatgtatctgttagacattaataccgtgcaaattcagtatgttttagtgttttgatctattgatatcctttctattgaaggcaaggaacaatagttattcggggctttattagattttatttaatgctttcataaagaagcacagatattactatttatcaactgtaatttttaatatttgagaactatattttggtgtaattgtttttttaatcctgtgtattttatgcattttaaaacattctgaaaaggggtccatcaatttggctaaactgcagaggcatacagggtacacagaaaaagttaagaatcatcctctggatgggcgcggtggctcacgattgtaatcccagcactttgggaggctgaggcaggcagatcacgaggtcaagagattgagaccatcctggccaacatgccgaaaccccgtctgtactaaaaatacaaaaattagctgggcatggtggcatgcacttgtagtcccagctacttgggaggctgaggcaggataattgcttgaagccaggaggcggaggttgcagtgagccaagattgcgccactgcactccagcctgggcgacagggcgagactccatctcaacaacgacaacaacaacaacaacaacaaagaaccaacaacaacaacaacaaagaaccaccaccaccaccaccaacaacaacaacaaagaatcattctccattccccaaaccctaaagccaggaagggagtaagattaactttagaaattaataaatagagttttggatctctactctgccttttaggagctctgtggatgggacgttttacttctgactgtcattctctgtgttataaaatgagtataatatatctgtcacagatttgtgatgagagttaaaatggacactttatataatatacctggcagagtaacaggcacatagaatgaatgttgttacccctttggtccttagtcttatcatgaactagctatgtccttagccaaattacttaccactttttgatctttgttacctatttatctacactgaaaggatttagatttgtatatttctacttcagctaaaaaaaatctgtgattatgtaaaaaaccaggattacctttttcaaattggaatgcttggtcagctaagcttttattttgttgattaaagacatgcatatatcaacaggcattgtcttttgtgtccatgccacctaacttttctctaccagttttctctcattaaatgtttgtcagtcacatttggttgaaaccatgctgtttatccaacgtcatgacttaaagtaaaggacaatttacttaattgtcttaaataccagtcagagccatgtggaagctatgcaggtaaacaagcctctttttggggttgggttgtaggaaccctgccttaggtctaatgaaagtgatattcttgtgtattttcaggggtcatcctctgtccttaccttcagttccagtagctctttaaacctcatttgttctattgacgccaagttggttagaaggtcatagcgttggtttgtgtgtaggaggttagagggaggtcctggcagaggcttataatcaagtagaagcgtaaagccagagttcttgattgcaaagagtagaagtagcctctttgactcagggaacgacctcattggaaggggtgtcaggttgctgtcataacccccaacacaggtggatatctgtgtttaaaagacagtgaggaacaaggggaagaagctatgcagccaggacaggggatatcaccacccatgagcagcctggatcttggatgctgcctccacagggagcactggacccctgtgagcacctgcagtggttccctggccggagttcaggcagggcgggcatctggcctggctgccctgctgagcaggactcaacagcagtggagtccccaactgtggggcgaggattctgatgctgggcggtcgaggggaaatgtaagcccaacaacagatgaaggttttctatagatgggctcagcagttgttggaactgcttattatctgtgtatgtgtgtgtgcctgtgtgggcgtgcatgcatatgcctgcattttggagaggaagggatctgggcttttatcaaagtcctgaaaggtcttttgatccaggagttaagaaacactgtaataaagagatttaactgtgttcgaatctttgcttttccaccaggtggtgcaaatcttttatgatgttcatagaggttaaatcctcaaaaataagaataatttaaaattgtgtaattttctctaagagtttagtcctgtcacacaatgtgaagcattgttgatctgattcttgctttccttctgtctttaataaagatacaggtagatttacatatctttttaaatacgtaactatagatctaaattatctgtagatttttgaggctgtactactgttttgttttttgtagaaagaaactgcaatgactgggaaaaacagtaatatattcaatatattaattgtttcacacactctttgtgaaacacccaattctgataactttttgctcaatgcatataacttgtgtgatttaaatttttgaagataaaactcatgtcatgttggtcagtgtattaggccgttcttacattgctataaagcagtacctgagactgagtaatttctaagaaaagaggtttaattggcttatggttctccaggctgtacaggaagcatagcactggcatctgcctctggggaggcctcaggaagcttccaatcatggtggaaagtgaagagggagtaggcacatcgcatggcaaggtgggggagtgaagagtggtgggggggacgtgccacacacttttaaacaaccagatctcaggagaactcactctcacgaagacagtaccaagccatgaggggtgtgtccccatgatccagccccacctccagcattgggcattacaatacaacatgagatttgggttgggacaaatatccaaactatcagtcggtctgtttgtctctttttctcctctgagctgttgacagtttgctctctctcctgcatctttctgtttttagaaataaatagccagccgggcgcagtgtggctcacgcctgtaatcccagcactttgggaggctgaggcaggcggatcacaaggtcaggagatcgagaccatcctggctaacatggtgaaaccctgtctctactaaaaattcaaaaacactagccgggcatggtggtgggcacctgtagtcccagttacttgggaggctgaggcaggagaatggcgtgaacccgggaggcggagcttgtagtgagccgagatcccgccattgcactccagcctgggcgacagagcgagactccgtctaaaaaaaaaaaaaaaaaaaaaaaagccggagaaagtgggttgctaatatgggctactgtatacattacattctagcttacatgtttttttttttttccttccccccaacttaagaatttggtgtagacatccttcatgtccttcaggtcattacatgcagattttaatttgttaatttgttacatcatctctagtaagaatttacctaatttagttatttctttgatagaacaaattaattgtttgtttgtttgttttgttgagacagagtctcgctctctcgcccaggctggagttcagttgcttgatcttggctcactgcaacctccgcctcccaggttcaagcaattcttctgcctcagccaagtagctggaattaaagttccatgccaccatgcctggctaattttttgtatttttagtagaaacgggttttcaccgtgttagctaggatggtcttgatctcctgaccttgtgatccgcccgccttggcctcccaaagtgctggggttataggtgtgagtcaccgtgcctggccagttttgttttttatttcttttcagttttgcttttatttttgccattacaaacgactgcagtaaacatccttacatcctttgtacatagattgtatttgttaatattcgtacgcttttttttttttttttttgagacggagtctcgctctgtcgccaaggcgggactgcggactgcagtggcgcaatctcggctcactgcaagctccgcttcccgggttcacgccattctcctgcctcagcctcccgagtagctgggactacaggcgcccgccaccgcgcctggctaattttttttgtattttcagtagagacggggtttcaccttgttagccaggatggtctccatctcctgacctcatgatccacccgcctcggcctcccaaagtgctgggattacaggcgtgagccaccgcacccggccgcttttttttttttttttgagacagagtctccctctgttgcccaggctggagtgcagtggcccgatcacagctcactgcagcctcaggtctcccagactactgagattataggtgtgtgcccccataccctatcttatgcttttatttttataatatatattatttacagtgattctctcaatctatattttagttctattagtggtgcctttattatacagaattttaaaacttttttgtagttgaatccgtcaacatgttttctattctaacctgcaattatacaaatagcccttctaaagtttcttctaatatttctaatagaaataggtttagtttatcaaatattttattgattccaaaatatgtagttttttaaaaaactttcatatatctgaagttatttcttataatagtgtatcataacttagctaatagtactttttctttcagtgatacataaaataatggtttctgttataattgatgttttgaattcagcgtaattggtatttcttgcacttagatctttaatccatttgtacttatttttgtgtatgtcatgaggttatggagtccatttttccccctacaaataaagccgatttctcagtgttgtttactaaatgaagaatcttttctcgcagaattgccatgtagtaacttctgatatatactttgactcctggcctgatccactaatttatttgttcctgtgctatactcttttgacaacagtggtttttagttctaaattccaaaagggtaagtttgccttcactgtacttttttattttaaacatttcttaatgtttacttgaaataccctaacttttgattctcaagtctctgtttttacctactctctttacttacaaaatgagttgatccaggcaggcattttatgtgatatttatatgcgcatgagtgctcatgtaatggcatttctcctattcccactttctaagtgaaaatttttttttttttttttttttttggagacagagtcttactctgtcacccaggctggagtgcaatggcatgatctcagttcactgcaacctccacctcccaggttcaagtgattctcctgcctcagcctcccaaatagctgggattacaggacaggctcctgccaccacagccagctaatttttgtatttttggtagagccggggttttaccatgttggtcaggctggtctcaaactcctgacctcaggtgatccacctgcctcagcctcccaaagtgctgggattacaggcgtgaggcaccgtgcccagccgtgtaatttgttttttaagaaggttcatgattttcctggatttgttcttagctcggtggcactggtggcttcagcatcaagtgcagaagttctcgttgaaccgacgctgatcagcgtccccttgctgtgttgttcgtggcacttctgtaatttatgtctagagactgtctgggttttgtgggatttctagcaattttagtgtctctgtcctctgatgccagtggcactccagtcattatgataaaagtttccacagagttttgcttcagagtaatctgaggggtggatctcgggtgtggaggagtatatggagaattgttgaagatggggagcgtgtgaatgtgtggttattctgggctctctttttaaatatacattgggaatgtttatgtttttcaaggccctgcatgtgtaaatgatgctttctatggggtgagcctgcccgtgtggagaccactatcttaaagccgtgaatggcacggcgcaaatgggtttctgggctcctgaataagaattctaagtgaatctccaccacccccatagaacgctgttttaatcaattattgggttctgtgttaatgttttactattttagggatcaatttatggacttttatggactggtcaagatagcaaccaaatgtataatttttcctaagggggaaaatatattctaatttctaaacaataatattttcagttgaattttaaaacagcagttttttttgttggcaccaaagggtaccttgggaagctttcctttccccacccctcaccatcctatcgccctgttaacgcccctcaaagcagtcaaagccagcgcacctgtgtacagctgagggcttgctgtcccccactcaaagccagtgcacctgtgtacagctgagggctcactgtgcccccctcaaagccagtgcacctgtgtacagctgagggctcactgtgcccccctcaaagccagcgcacctgtttacagctgagggcttgctgtcctccactaaaagccagtgcacctgtgtgcagctgagggctttctgtcccccattcaaagccagcacacctgtgtacagctgaggacttgctgtcccccactcaaagccagtgcacctgtgtacagctgagggctcactgtgcccccctcaaagccagcgcacctgtgtacagctgagggcttgctgtgcatgtgtgtttgcagtgaagtgcctcagccagttcctccttccttctccaagctgactggacccacatccctcctgtgtagacattttggagcctccgctgtgatgcttgcctgtaacccatcaatagagctaagtcaaatttgctttttaagaaggttcatgtttattttctggttctagggcttctgtggctatttagatgagttgtttagaacactagactaatgagatcaccagggtgatgaaacattgtgtggatcttggctttcttctagcacagtcagctctgttcctaaccctcgccatctactgggcatttttattcatatgcttgatcagaagttggcttgggtgaatgtgtgtgtggatccaaatacatccaccgttcatctcagagaagcagctcatcacctgggtcctgggagggtgccctgtattgctcactggatggagaggcagggcagctttatttcacaccagctattggcttctgatacgttagattcacctgaaaggagggtggagcatggtggggtttatgttaacatgccagggcagatgtatttgtttgtatatttcctttaacatctcatgagttgggcacatttttaaaggtgctgttagggtagaaaggaggcccaggaccactgtgctgccagctttagaatacattgtgaatggtgtctcctgggattgtgcagtgagcacagccttgagatagcccattaatttcttcagtaaatgcatgttgagttaatgcttggtaatgaagtgtaccctgctatgttagggaatgtttgttagaggtgattgattgtaacccactggtgccatggaagatatgttagcatggtgattttagcacataaatgcctctggtgacaaagctcaaacctcatttattaaatgacaattaaaattgccttataattttaacaatgtatgcctgttaaaatgttctccatcacatctgcagtggtgaatacgtgcctaataaaaatttgataataacgaatagtcccaaatatttggaagccaataattgtctttatgctttataattatctttaaaattctacccatttgaaatccacctgtttatatttctaatacttgaaatttttttgtgaatgaatgtgagtctgaaaagaatgttaagtatcttctttgaaatgtcaagtgaagagatgagattcatgtaatttaaatcacccacaattcactgggagaaatttttaaataattttagcaatataaaaactaatgagaaaaattacaccttgattgttttaagtatctgaattacctttgtagattttatagactttatgttcaaaaaataattttatgtgtttacaaacactttgatattctaaacttgagtagcagtctaaaaattaaccatatggtaatattttgtctgtgttattagggataatggccaacatttattgagttcttactgcatttctggacctgttcaactctcattaccacatttaaccctgcaaaaaaagtcttgtggcacactgctatgttcattgtccccagttcagaaagaggaaagctaaggcctatagaaatgagaagctgcagcccccctagaaagtgaatgtcagagcagacactggagttagaatcctgggttgctggccaggtgcggtggctcacgcctgtaatctcatcactttgggaggctgaggtgggtggatcacgaggtcaagagatcgagacaatcctggccaacatggtaaaaccctgtctttaccaaaaatacaaaaattagccaggcatggtggcgcgtgcctgtagtcccagctactcggaaggctgaggcaggagaatcacttgaacccaggaggtggaggttgcagtgagctgagatcgtgccactgcacttcagcctggtgacagagcgagactctgtctcaaaattaaaaaaaagaattctgggtggcctcatccaaagctttacacttcttcttactgccactacactgtgtgtgtgtgtgtgtgtgtgtgtgtgtgtttgagatggagtctcgctctgtagcacaggctggagtgcagtggcgtgaccttggctcactgcaatcttcgcctcctgggttcaagcaattcccctgcctcagcctcccgagtaactgggattacaggtgtccaccaccacgcctggctaatttttgtatttttagtagagacggggtttcaccatgttggccaggctggtctggaactcctgaccttgtgatctaccagcctcagcctcccaaagtgctgggattacaggtgtgagccaccgcgcccagctgaccacattgttaaaggcataaaatactattccaatacttttagcagtaatttgtacattaaataagtgacataattctaaatgcctacaaatatgtgtaagtcttgtaacgttttgggaccatgctagtgtcaagtgtagcccttgtacagtgatgtacatgagcattaaaagaccatgcagttttaaacgactggagacattttgtcagtgtcttcacagaggaatcaggaagttggacggttggccagtgggtgaaatggtgttttcggaaggcataactgggcgaagggaggaagctgatttgcctgcatgtgctgctacctcgtggtccccacggtgctgggaggggagacaggttcatggtagccctgggcagcctaggtcacatcgcgggtctcacagccactggagcagaggtgctactcagaagcaggtgttctgccacaaacacatcttctttccgtcctgtcacactgctgattgctgttaagagtttggcctttccctcactctgcttttggagtgggattggctgagggtgtggatgtttccttcggttttcacccttacgtttcttaggcacttctaagggcacctttttcctgtggatgcacccggtaggtagctttttaattcagtggtatttccatcatgagagatcgcttgcagtcatggaaccctcttagtttcctcgataagctggtcaggaaagaatttcagacctttgttttgggttcattgcacttgtcttttcagagcagtaccctccttgcttttcacatctgagtactgagcagtttgcgtggttctggcacgtgcctagaggccctctgaatttgtaagtgagctgtaggctcaactgttgctgttccattttgcaggtaggatgcatctggactcttctgtttttcactagctttcatgaccatgggcttttcagcttcttacaagatttctgttaagcgggcatctccatttcagccagttctttgtcccagcttcaaaagtcataaattttagctgccattgggcccagtgataagagtaggtgggccatggtgaagcgtaaggccttgggaaggcacttgtgcgccgtccgcggcagcagggtatgtcaaggctggagagtggacaccttcttgctcctttagataagggaaagaacatttgcttgaataaaaaattagggtcatatttttctgaactttgtcacctagacattaaatgataatttagaattgagaagagatggcatacatttccaatactctacctctctccagcaattcttggccttccaaccaatatgcccatcatcccaccccaaaatcttaccttttttaaaatttattttttagtaatcaagattctacttgtgagtcacagagtatttaaaaacatgcacaatctgttgttcatggtacctggatacactctctaattgaaaattcaacatttaagggcgaatacagaatgcttgtttttaaaaatacctttccagtttaaagaaccatagaggctaaaacgagattgtctcctttttagtattactcacatcaaaattattcaatctttgtgaaactgagatacaggcttgttttgtgaccctttctttccagttactggctcacttttgagcaaaatggtgaagctgttctttctgcttggggacagttttgtattattttctctctcctagtctgcacaattcaaaccaaaatcaagcctcagagtgtttatgtggtatctactgggcacactggctgcttaatgcattttaatatgatgttagtaaaagaaaatgtggagatagttactcattgggcattatgatgagattttagattccaaagtctagccaactctggcttacccaaaggaaaataaaagaggtgagaatacagcaaaaggtgggtgtgggcagggggaagagtatggggtgattctcccaagcctttataaccagaacatttattatggggtgtgggttaccaaataacaggaacacccttgaaacaggtgctaatatgttgaaatctttttggtacacagaggcttgagattaatgacatttcttatgtcaggattcacctgtttttaaggtgcaggtagtgttggcaggccccctcgtgagcagccttcctctgcagggttctgaccctctctcttcctctctctaagatttggctactgagtgggtcagcacctggagaaaggggatctgagtggtgttttaacccctcagggagcttgtggcgtgacagcactggctttctgtgttcggcagagtgtgtgagaccttgcgcgaggaggtgaccatcatgccagttgctctgcctgatcggatgtgtctctttaaatgactatacgatattaaagttaaaggagggctcttagatatttagattttgtccagttctctgttcacaaatcaacacaaataatcaaagaaggtatttttctgtctgcttgctcagataataaatgctatttatatgtagaaagaaagatggagggatgatttacagatgactcaaacttatttaaaaacaaatttgtggatttccactaataagcttatactttcatggcacacttgagtagtttttattaaacttcctttttctcgtatgctctatttgggatttcaacaatttttattatgtaatgagggaatatttttgttgtgaaatttttcttcctttttgatgtaactgttagaatttgatgaactggtttgtaacattaaaatgaagatgaaaaattacaaggtattcaccaaatgaatgtcactttctggggtgttgctggcgatgatatgggctctctggagcatatatatccggaggtgctcagagtctgcccctgttgctcctaagaaagacaaagcctcctatctgatcagctttgtccatgactctctaacttgttcttacactgacaccattaactgccctaaatgccaggcacctactccgccagcccagtggaaacaagcctgtattagtaaaccgcgattgggtttagaattgggactgttccacatgctctctacttgccagataagccttagcatcctcatctgtgaataacgagagttcatgcctgccacacatgggcactgtaaaaattaaacaccatcggccgggtgcgctggctcacgcctgtaatcccagcactttggaaggccaagacgggcggatcatgaggtcaggagatcgagaccatcctggctaacacggtgaaaccctgtctctactaaaaattcaaaaacactagccgggcgtagtggcaggcacctgtagtcccagttactcgggaggctgaggcaggagaatggcgtgaacccgggaggcggagcttgcagtgagccgagatcacgccactacactccagcctgggcgacagagagagactccgtctcaaaaaaaaaaaaataaaaaaattaaacaccatgggtccagctgggcgactcccatcctctcctcaagaatcataaacatctttctttgctttcaagattagctctcgcagtcgggccctgtcaggcccctccagacagtctcactgtagatgcccttgctttctagcccttggcctggtgggccatttgctcatcctaagtaggcctttcctgcttccaagtctttgctcctacttttggggggtcttaatctccacctattgaaatgttctattgatgaaggtagaagtggtgggaaatggtatcggggaaccacaggccaggcgctaggcatgctcattgctactgggttggccgttgcttccaggcctgttcagtggacgctgagtgcatgtgtgtagcagatacacaagtgcatatatatatatatatatatatatatatatgtatattaaaataaatatcaggacgacagggtttttacttcacctcttggatcttatacttctgtctcctttctctcacagcgagaatgcttgtactcctggaatggcagaattacttacttgctttgatatacacagcagttcagactactaatgccagcaccaataccaccatttttcttttgtcattagtttatgtcccactacggatataggattaatgtatttcactgtcagtcattcttctctgtgtggttatgctaccaccttataaatgcagggttcatttgtcacattttatttttgatttttaggagtttttatttaaaatttttgttttacaatcacagaaaatatttacatgactccaaagtagcatctagaaaacaagatactgtcaaaaaagtccatcttctatctctgccttctcccctccagtaagtaaccatttaagaatattatgttttatctttccatttttgcctttactatgtgtgtgtatacatagtgtatgtatgtaaatactatataattagtgcattttattatttcaccctaattaaatataatatatagataaaatataaatagatacaggtatctttacatgttaacatgcagtctaaccattttttttgtttctcgggaagggaggtggtggggagggtggtacatgaatgggtattactaaaattactttattaggtgggctgaagtttttatttgtttttgtttctttttatataaatctttataaacgcttattcactgtgctttttacttttagtcagcttctctttccatatttacacttgtccataattatacttcagcaatcttgggagagaacctctgtggctttctgaaaaattattcttttatataaacttgcccagatgagttataggaggaactgttctctccagtttcaaaatgagtttacatactgtgtggggggactttccaactgaggatagcatgtcgtggtgtgtggttagccaatacagagatctaagaggctgcacggcttttgctaacttgtgaaacatgcctttaattttaaaagcagtctttggaaattctacttccatttgtacatggctttagatgaataaagacatgtcttcttacggaatcaagaccacggcatatgtatacaggcagatgatgaatgtattgattcttttacttcaccttatatttactcaacaaggagacatctaaataatgaaatgcatcttactggaaccacccaaagtaagccacttagagggccacctagagatagctttgtagagcatgatggaatatctgagggtttttattaatacattttaactttcttaaacatcatttaaaaaattaatgttctaaatatacctccaatagtacatgaaactgttacaatagtgtccgaaccttatgtgtgtaaagttatttggtcagtttggaaaattttgtagtatttgtgaagaagggtacaagagctaacatacattgagtatctactctgtgtctggtgtgttccatcagtcatctctttcaggaattaaaactatcttatgaggcagatagcactatttaattttttgttatgaaagaggctgagacttggagagttggagtctcttgccttgtatcatgtacctagtaaatggccaaactaggaattgagcctcagttttgtctgaaaacaaattcttactgttcccagtgtaccttgttaccacaatttactttcttttcttgtcttaaaatgaagtctgaggttctaatttcaccagattaagactaggtaaccatctgtaaactagaaattttaattgataaaacaatcattcctgtgctttaaaaatgcaggctaaaatggttaggaaatgctatcttttggagacttgtagcaaatgctcagaaagtaatttcttggggttgggcggggattctcatcacagtttttaaaataatttgattgtcattattgcaaagctgtgtagttcctgtaattggagtatttgcctttacacttcacagctataattttcttcaagatcggaagactttctgagcagctgctttaatttacatctgttttggggaaaatataacacatgtccatagtatatggtgttcattataaagatttgcagtagacaaggtataaaattattataaatatttcccaatatgctgttcatgtgtgtgtgtgtgtctgtgtgtgtgtagggatattttgtggcatatatagccaaattttatttgctgttctttaaacattgagatgtcctgactgtcaatttgtggtttgtttaaaagaagagtgggatttttttctagtcaagttagaagataaagtttaccaaggatacaaataagagaagcagtatagaaatgtattataagccatggaaaattattataagaaaacaccattaattataaattaactaaaattttaggatatgacaaaaaaaacataaataggtacctgtgagtcttaaggggcaaaagactaatagaaatattctgaggccctgtggagatggtgtgggggagttctgagtccatagccctaggtaagggcagaattgattccatgtcttgactgaaaccaaagtggaggtgggatagggggatgctctgttgggggctgtgtactgcttaagctaggatatatttggagagaaaagaaaacattaattttcctttctcaatcatagcaaaccccttcccccacaaaacagaaattgacaagagaaccctagagataaatctgccaagctctgttatatggtggctttcagcccttttccagaataaataggatgaacatcttggtacataacgtatcttttacttaaggtcattatttttttcaataaagaatatgacaaataggataacagaaagggaacgtacatttgatccttctccatgtggaaatgtgagctacaacttgttagtatcagaaacgtaggttatctttcccttctccatttcaaatagtctgtcatatttgaaagctaatagctttcaggctcgcattgcccataactctcagcaacatataaaacatgcccactctgtgtttatttactttaatctgtcaattgtgatgccaactcaagatatttgggattattacatttgattcactcatttgcctgatgactctgcaaataattggattgataccaaggtttatgctgtggaaactatggtatgaaaaacagtatatagtctataggtatatttacaagaaaacatacactatatgtttgtttcagaaaatttggaagatccacatacagaagttatagtcactcataactgtaccatccagaaataactactattaacaatttgatatctttcatttatatgtatacatatggatatatatgcatatacctacatatgtatctagactatatatacatgcacatttacacacatatacatatgaatatataactacacatgaattttaaagcacagttggcatcatacagtatatcttttgggatgctccccttaatattatctattactagtatttttcggtgtcattaaaattccctataaacatcagtttcaaatgactgcataatattgtatcacatgacttcaccataatgaactttttttgctgttattagtttgtttccattttatttggttatcgtggaacctcttttttcacttttctgattaacatacatgatttcatgacatagcatattatttgatgttgtgcttcttgctcattaaaaaatctgagcatttgagaagaacctaattcagggttgtgatattcatttgtatgtttatcctgaaatacttctaaggaaaaaattatctacatgttaaatacccattttagaaagttacctttgttagcttcagtttgatctactttcattcagtttctcgtgagatgtagattgtcttctcgctaggtagtcagacttctgtgcagaacaagatgggcaagttcctgctcttgtagagtttactgcctagtgggaaagtataatactaagtaattaatacattattatagaattatacttgcaataaacattacgaacctaaagttatagtatgtttttagaatgtatacttgaggaatctaaacaggaaagaaaattcttcagttaaaatcatgattttcagtggctcacgcctgtaatcccatcactttgggaggccaaggcggacgaatcacgaggtcaggagatcgagaccatcctggccaacacggtgaaactccgtctctactaaaaatgcaaaaattagctgggcatggtggcacgtgcctgtaatcccagctactcgggaggctgaggcaggagaaccccttgaactaggaagtcagaggttgcagtgagctgagatccgccactgcactccagcctggcaacagagtgagactccgtctcaaaaaaaaaataaaaagtcattattttgttatctttttttgtttctatttaaaatagaaaaccacaatgcctcatctgaccagttggcacaaaccggaggatacaatatggacatggtatttatatgtttttctctcaccaatatccagtttacaggagaagaaatctttaatccttttggttggatatttgatttctgagctggaatttttttctaagctagcaaatttcaggatacaaattgagttatttctgccagcatcctggattggaatcatgagatttcatcactatgattaaaagagcctttccctgctcacaaagcaagttaaacaaaatcagcaagatgatggagataaacgtgcttggtccataaagcccaagacaagtgttctattaagctagtgctgttataaagtgagcacagggagatatggaaggctagtgtgcatcattttggggaactgtactatatgtaatattcgtgcaaaagatgagctgttatttgctccttttattttatatgcgcttgctcagcaccttaggtagcagaagtcatatattggattaaatggctctaggcacttgttctaggggccctagttttatccttgatctggtaaaaggctggaatagagaaactaaggttaaaaaaaaagattaatgaagaagcggaagtgaagagtctggagcagaaaataagtttaaatgtctttgggatttatttggaggtgaaataggatcaataaattactagtgtgttactgggcaatgtgaggtttgaagatgaaggaagtgtcttgaatgtacttactatgttgtatagagccttagactcgaggtagtatgatgttcttaaggaaaagtggaaagattaatattaataataataatctgtgtttccttcagtcgaattcatagcagttaatgtcttgccacatttgccttatctctgtatatgtacttttttgttcatttatttgttgtacatttgaaagtgtattaaagttatcaatttttgtaagttgaatttgaatatgccactttactgaattcttattcttatcgattcagttgattttggggggatttgtctaattagattatcatatcagctgcaaataaaatgattttgtttctttacaatttttatgcatcttttaaattttttgtaattttattacattgtccaggactctagtgaagtatcaaatactatcattggtaaaaacgcgactttaatggcaatgcttctggtagttcacagttaaatacaagttagcttctcagacattgtttacatagttttggaaattattttaatcataactttttgagtattttgcaaataatggtatggttttttgtttttgtttttttttttcaaacagaatcttgctttgttacccaggctggagtgcagtggcatgatcttggctcactgcagtttctgcctcctgagctcaagtgatcctcccatcttagcctcccaagtagctgggactacaggtgtgcagcaccacacctgactaattttttaaatcttttttggtagagatggtgtttcaccatgttgcctagtctgggtatggaatttttatcagtgttttggtttaacatgtctgtataatgaattgtaagcatagatttttctgatgacaaagctatccttatattctggagctctaacttggtgatgatattttagtctttttatatacttgagtacaactgtattttaaattaatgaatatagatgctattgtgactgatgaaataacaggtgcatttaaaagtattgcctgtatttttattattgatatgtttgctaaatcaacagatagtaaaaatataactactgtcacctggaggactatagcattgtttgttggaaagaagacctcatgcttgaaatggttggcagtcagtaatctagatacttagaaaaaatgcatattttcctccttaccccttttttggtagttttgcatgtgagtatatggtatatggtctagagatgatcttgatattaatctgcagattccgcaatctcagaaataagaggaacttgaagaggttacctccattgttctgttttctgtttatcaaagactctcagagatgatgactgtgttatagtctcatgaagtaactcattctaaagcttcaccatcagttggtatctcctaactttgatgttctggggtattctagttagtaggctcttctgatatgctcaggattggttaagaggcttctttcttgaatatttgatattataactctttctaaatagattagaatgatgaatataaaatttaataattatttggacaatgggaggggagtcagtagaatcctttctaatagtaatacagtaactgtaaaatgtgaagaatagtgtgcatcattttggggaagaacgtttagagtagcactcggcatgtagtttgcactcattaaagattacttcttattgtctaacaaatactcaaatattttattccccatagccttttgacttgcatgagtaattgaaaaaaagaaaaccaattgtggctttcttgctaaacagatgtttagagtacataagtccctgaggccagcatgttgagttgtcacatcgctttagtgtgagaaggaaggcatctaggtaatcagattgattctgattgtttcaaaccaaaatgctgctgtcatgtaagggggctttggtctgagagtgtttgtcagtgtcaatattgccagtgatttggaaaaaaaaaaagtgtaaaatttatatatactgcatttataaagtgcttagtggtaattctgcaaatgttagtgttttgaaaatagcattcatccagtcatgtgtttagagaaatagaaattgtcaaaaggaagttaaaggggttgatgatgtcatttacattttagttccactcccaagttggctggctcttttgaagttgactcttaaaatcctagagtcattgatcttatagctgaaaggaacctggagagcattgattcaaaatatgtttgttgttgttgttggaacaaatattgcgttagatattagagatataaaaatgaataaaatatggctgttgcccttaaagtctagcctaaaagatagacaacctgaacaaatactttactttggggtagtaagttctggaatggaagctttaggcagggggtagattttccatgtttcctaggtgtggctccagcagcttgggcaagcagcccaggcgcaaacagctccgtactggtgatggtattgctggaactagactcctggtctcttgatacaagtcacgtggggctgacctagtaagctttgcaaaagaaaattttaccaagcatgcatgtatgcatgtaaatatctatgtaagtatgtacatatgtattgatttagtaccttgctctgtgtagttaacagctgctttatgtgagacgcatagacatagacattcatgcttacttttttttttttcttttttggagacagagtgtcactctgtttgttgcccaggctggagtgcagtgacacaatcttggctcactgcaacctccacctcccaggttcaagcaattctcctgccttagcctcccaaatagctgaacattatattgttcaccagtagtatcttgttccaggctatttcaattggaattattattattagaccatcacatgtttataaccacttacagaatttgataccactgtacctagctaatttttgtatttttagaagagatggggttttgccatgttggccaggctggtctccaactcctgacctcaagtgatccacctgcctcggcctcccaaagtgctggaattacaggcgtgagccactgcgcccagccaacattcatactttcttatcctacattttttggggggcggggtacagaggttgggtggggattcccgctaaacatttagaaccaacagcaatgaataatttgagtaatttgtaatgtgattgtgttattgtgttatctagaacactatactctaaccctaaacctcaagataaaggcttagattcctttcacgttactgtgtccatgatcttgactgcttcttctgccacatccctccggtggtgctccctgcattgccacctacctggggttctcctcgcctactgtgctgtttctaaccatcatgcttttccctgaatctcttgagtctttttctgctgtggactgaaacttgatcctgagattcacctctagtccctctgggcagcctcctggaatactcagctgggatgggttggggctgcttgaggtacagctcccactgcctctgagtggccctccatgaaaatgcctcatgtctctgtgtccctaaactgtagggtacgtagcacattggtagatacttagtaaatgttttgctgaagaattcaagtttttaaattgcccttttcattggacaactaaaaaatgtgtatgcatatacatgtatacatatatatgtactttttaatgttctaattctcttgtattgtttttcatgtaaacataactgttttggatttcaattgatttcgaatacatgttttggagaatattaaacccaccacgtttatattgttcaccagtagtatcttgttccaagctatttcaattggaattctttttattagaccatcacatgtttataaccacttacagaatttgatactttggtgcatcccatggattaaaacatactttaaaatctgacatctatatattaaacagttattgtaagcatgattttgttaatggggatttacatctgctttccaatctctgtagccatatgaagtgtaactagccattatatttgcttctttaaatatatatctgggaaataaaacttcagacaattacagtataaactaaacctgataacaattgaataatgaatgataatctgttcagtttttccctcctgtagaattagatagttgatgatttggtttaaaagtaaaaatattttttaaaaccttgacttttctaaataaatgagaatctgcaaaagaaacaatgcatattaagtactgattgtttcttgactgtcataatggatggcctctctctctctgtcgtttttaagaaagccaaattacaggatagttaatatcttaaaggactcttatctcaaatactaggatgctgagacataaagggggcttgctgagatactgtgtcagtaaatgaaactcagcaaatcataatcatctttggattctcagtcatgttatgtaagtggtcacacagatggatttttaactctgattttcctaagttgctttcctggccattaaacggttgggaaggtactctcggatgcagaataagaagaatgcattactgtgactttaagaaggaaattaagtagggagggaaaatggggatgttgtgactgctgacatttgtggcctcctttcatttgcgtaagagatggactggcttctctgtggctgcggttgccatggagaggtagtgggggaggacttccaggaggcagcccatgagcgagagtctgccttagagctgctcctagatgtgacgtgaaggggcagggagctcaggtgtgccgcggcggcacagataatggggatggccgacctgtcatggctggtaacgtgactgtgcacatacccctgggtgtgacggatgtgtttgtgcaagtgcctgtggattctctatgtgaaatgaaaggattgtaatgttgtgtgtgttcccaccctttgatgcgatttcctacacttgatgtgatttgatgaaaagagtttaaacaattaaaccaaatgtacaccctggttataaaaagagactaacttcaattggcacgtttgcatataggtaaatgacatcaatagcaggtcaaataaattactgtgggactaatacactcagaaaaatctaatatggtaggttaaactgtaaccagaaatgactgtgttactaacctggtatcattgttatacagatattacagagtggtgtagctggctaatagaagaaaaacgaaacaatgaaagttagaagatttttttctgcataaaatgtagaagaaaatcacttgcatgttttgtagataaaatgcttatatctgaagagatgaattttgagaattttgatcattgttatagtatattttattggaaatacttttatatcaaatagaaaattgctaacaagtttatagtatgatcattttatggcttttgttgacataagtggtaaattgaatatgaaaattatatttgtcttttgttttcttgtggatatcattgtggatattgcctttgtttaaaaataaatgtgattggtaattttaacttaaacaccaagctacagtttaaaaaaaatttctaagtaaaaatctatttctcgtgaggaaatcctatgatgtattaaatttaccaaatataaagaaacttacttgacttcttagttttctgatgaaatttgaatgagagccaagtattaatattgttttatagtagagtcaaaaatagtttaggtgaaataatacattgtcagtttgttagtcattgactgcttaatgcatattacaacttatttaaagaataactagttgcctaagtcaaatctgtgaaatgaatgccaaatcttttctttttaaaagtatagtgttaggtaaaatctaggtgatggtgttacatagtgccactgaacaaatttgtagaatgttcagatttacttagaatttacttagaaattattacattaagttaaaatatttcagaaattacttaatacatgttagagattatatatataaaactattcctttaatgataaccttatttggcttcctaaaccttccatttcttttttatttggaatattgtatagtaagtctaaatttctttaccttttgagtacgatatttaaatgtataaacatttatgagttattagatacagatattgatgtaattaaacatttcattatttttcttaatttttaaattaattctaagttacatctattcagcaaggaagccaaaattggttttctttttttcaattgctcgtgcaagtcaaaaggctatggggaataaaatatttgagtatttgttagacaataagaagtaatctttaatgagtgccagctacatgccgagtgctactctaaatattcttattcttgttttttctgaatctcatgcaactttgtgaggtaggtaccattttctcacccattacagatgaggtaactgaggtttggcttataagtaacttgctcaatgtcataaagataagaaagggatagaccaggatttgaactgagagaagtttctaacacccacacgttactgtcattttgcgtattgaaagtatagtgtagtctggcatagtgggaaaagctttctgttcaggtgtcctgggatggaatcccagctttccttgtcttagctgagtgaccgaagttacgcctcttcatgccttagttttctcacaggtacttactagaagaatacatgtgagtactttcattcttgtgctaaatgtgaagactcccctgttagtagtagttattgctaacacgtatcattattcatgatttaaaaatataatatgctaatctaaattatgttttactctttttggaaatagttaatagaataaaaggaggaataaagaggatatgattaaagtaatattgaatgcttttcagttatcattaaaatatttattgatttctagcagagtttttcaacctcagctccatttatgatttggcctagataattctttgtcttgggcactgtcctgtgtgtcacgggatatttgacagactccctggcctgtacccactagatgccaattgcagtcttcctccctcagttgtaaaccaagatgtctccaggcatttccaaatgccttttggggggcaaaatcaccccaacctaaaaaccactagtggagttatatggcattaaacaagattgggatgaggacattggtggaaagtggggagggaggagctggctcatgttggcaggtgtggctgcacgtggaaggtgggttggaaggcagggaagggcaggagcagatgccatgcagaggactgcaaagaggcagaggcagatgtcttggggagagaaggggcttggatctgggtggctgaagtgggcagcttggagaggtttttggaggaagaatcagaggacttggggattgccagagtattacacatttgacagcacttaataaagaacagtgaaggttttgagaggtggtcactgggcagtctgcaagactgactctccaaccaagtgaaacctcttgtgtaccagcttcaccatgcatgagattcacatatgtttcttagtggtaaaaatcattgcatgtcctagaccttcctgagcactgcaaaccttgggtcttaagtttgggactgccaagtgactcccatatttaaaacttccatgatttgccttggtttgaagattaggtgtgatcttggaaaatgagagacctcagattttggcaaggaacatgccttggtataatatataatattccctcttcctggattcttgccaggttgcttgctcctacccaggtttctggccttgaccctagagctttcttctctaatgcatctacttgtaaactaaataattcattggacaccaaataaattttttttaatgtattgtgactcagtgtttttgagtcacaattttgaagtttacggatttctggaagcaatgcatccctatagtgggaacggcatatgtatcataaattttgtaaatggtaatgactaaagtattccagactctttctgtgttacaacagtcagggaaaccagatgaagtttctttctttctcagcaaataacctcagcaggctgttttgggagctatttcaataaggtcatcacaagcagaacttaatgatcgtttgttaacagcagtgggtgacatcaccacgaattgtaattgcaacttaaatgatagtattataaggtactttttagtgttcattatttcagtagtggtgataaaacctttttttattctgcaaaattatgctggtgaaattgtatgtatctgcatgtgtctgtctgtgatttctaccatagtaaaatgaaacttcagttttgagccagaactgagaactcttggttcttaggtctagcccaagagaagacaaaagggaagagaagggagaggctacctttcctgacagcttcatggagttttcattttttgtgtgtcccctccccacgccgtacacacacatattcccattacacttctgttgatcagttagatcagttagtggctgctctgtttttccctgcaaaaggaatttttcaatttgattttccatcccgatttcccagtgggccttcatgaagcagtcaagacattttcagtatgttctttccctccaacagatgtgaatccagccatattgagcatatgctgtgtttctagggctgtacacatactgtggggttggctcttctatcttcaggttgctaaaacatctcagatggaaaagagattcacacataatagataatttaaggcccaaaaaagacctaaatcatggtggacaaattggatgcaactaaatgccaaattgtatgaactaggtaaaggtctgtgcaatgtatagggaggcaagaaactgttactttcctggaatcattagtaggtgtttctgagagttggagttaaagcatgtcatgaaaaactggtgagttgtggataaatgttgggacctgggataggagaataactatgatagattctgatcatggcgtttgatattagagggtgatgcagacatgaaacaagcaaggtcacacacatacatttaacacaagaagaggtggggtgctgttggtgcacactggagtgctcccagttagtgtcaggagagagcttcaagagcatgtgacattgatgctcacacatgaaagatgagaagttgccaggtcaggcaggacgcccttttgatacacacatagaatacagggatgtggcatagagtatcactgtaccagcaacttcccgttctggaggcaaatctgcctgggttcaagctggttcttcccctgacgggctctgtgaattcgcttctgtgtgccactgtttgctcctctggaaaatggaggtgaagggtggtctcctcccaggtaggttttgtgtgtgtgtgtgtgtgtgtgcgtgtgtgtgtgtgtgtgtgtgcattgaatggttgttacaatataataactgaaaagagctctaagtccagttttattttagtgtgtttttgctgtgatttgcctaacttggtttctatgatgcagttagcttctgcaaatggcagagctgataaacgattagaaagctatttttggtttgactggttcagatgtagatgtgaagtcctcagaacagcactcagcacacaggaagctgttactgttggatatcccccagtagggcctgaagtgcgagggtgcggctgtgagtaaggagaatgagggcttcccaggcaggtgtaaaggaacattggggaggtgattctcatgagaaggaacaccatgagcttgaggcagcagtgggggaaggcaagctgtgtgctgtgggcatccctaaaaggcagtgttgttcattcaagaggagaattttcaaggggagcgattcttacgctggatgggaacagatagcttgtgcgctgtttccattggttttaagagctgtgtgcgtgtgtgttaattctgtgttttgctgtgtattttacatgtatcttagggagtttaagaaatagttaatcttgttaagtatccaaataattgcatgatgaccatccctcttgtgctaccacataataactgaaaagagctttaagtcttaagttcagttatatttctgtgtgttttcaccatgatttgtctaacttagtctctttgttgcagttagcttcttaggcaaatggcagcagctgataaatgatcagaaagctatttttggtttgactagttcagatccatacatatgaagttacaagcttaattactgttatttttggccagagtccttggaagtgttggacttagccaagtacttcctttgtgaaagaaatgacacttgttcattgtttgaattgtgatgatttctcaaagcatatgaattttttgactgcttagattatgaagatttagatggggaattttgtgcattataaattttatcataaataaatatttgttcggaaccactttaatgtatgatgggcccaatattatcattgtcttctctgagctatttcttcaaggtaacagtgaaaacgaataactagaaggcattatgtttatatataatgggatggtggatatatttcaaacaaagacactgtgtgtgtgtgtgtgtatatatatatacacacacatacactttattatatatacatacatacaaaatatatgtactgttatttagttaggctaatggctttgaacaacaataataatagtaatgtggattccagataatttattttcctgaaatataatttagtgtattttcatcagcagatttggtggtacattttctaagtattagtctttggaaaatccgtttagggaatatatctctgaatgtgttggctggttagagttagtgttagggatagggttagggtttaagtttaattaaaaaactaacttttaaataatgattaattattagtattatggatcttgcagttgactacctataaatttctttatgttttaaccattttctatttttattgaagtgtatcacttagtagttactatcatttacatttaaaattgtagcatggaaaattaataattggaatgttacatatttaatctatttctgtgaaactacaaaaaatttgtgaacttttctcatgaattctttaaaggaagttgactggccgtttagccatttattttacagaaataataataaggactatttaaacaatgtagttaattttaaagtttttgagcttggattttttttttaaggtatatttttcttgtggttataaaatgttaattcttccctgcttttgagtaggcgccaatggcgtagaatggtttggatttattgcatttatctgatgccaagctggagattattgggtgccctgcctgctgtgtgtccagctctgtgctgaggacagtggtgagcaactcctgcttgtgtccccaattcctgcctgtcctccccagaccatgcactccatggtctggtgaggggctgttatgatgaaaggaaacaactgctctggtagggaagggaaggtattaggttatgtggggtacaaatcaatggcccccaatgtagtcttgaggaattgtaagatgttagggtgtttgttggtttattttgatgataattcccaaataaagatcatatctgtagttgatgactaaagctgttagattttatccattgtattcattttatttttctcccctctaagacctacttatatttttcatacctttttaatttctgattcgtgctggtgagggggctgtgctttagaagagatgcagattttgagatgaaagagcagacttcttaactgacctcagaatactttttttgttttttgagatggagtttcgccctcgttgcccaggctggagtacagtggcacgatcttggctcagtgcaatctccgcctcctgggttcaagtgattctcttgcctcagcctcccaaatagctgggattacagatgcacaccaccatgcccgtctaattttgtatttttagtagaggcggggtttcaccgtgttggccagggtggtctcaaactcctgacctcaggtgatccgcccaccttggcttcccaaagtactaggattacaggcacgagccaccatgcccagcctgaccttagaatactttaactaacacttttaactaaattaaaggaatgtaaagggtaaagaatcatgttttgtaatacttataatagtattattgtcagttagatgatgttaaaatattcttaatttggaaggaggaaacaggcatcaaataaattggaagtatggaataatgtattgagtttaagggagaatacttaagaatctgacagtatgcgtatatattcatatatgtgcacacgtatttgtgaagatatatgtgtaaatcgtcacacatatatgtaatatgtgtattaagcatataagcaagcaggcacttatatactttcagggaattgagacacccaagtttgttttttatttggctgtccatatttacacatatgttcatatatattatacatacctgtgtatttaaatgagtaaataatatatctttaatatgagtaatacatgaacttaaatcaactaatacagaagcatatacaataaaaaattggtgttttctccctttacttgcctctgctctttatccttattatcagccttaccaatttcttgtcactttccccagaaatgcagctatgataatattattctttaaaacatgtgtgcacatacacaaaaattgacttatgtaatgtacaaagtcattaatcatttaacaatgggatacattctgagaaatgtgtcgttaggtgatttcctcattggtcattgtgcaaacaccatggggtgtacttacacaaacctagatggtacagccaactacacacgtagcctatatggtatagcctatcgctcctaggttacaaacctgcacagcatgttcatttactgaatactgtaggcaattacagcacagtggtatttgtgtatctaaacagaaaaggtatagtataaaagataaaaaattcatacaacctgtataggacacttaccatgaatagagcttgaaggactggaagtttctctgggttgagtcagtgagtgggtggtgagtggatggggaggcctaggacattactgcacgctactgtagactttataaatgctgtatacttaggatatactcaattttttaaaaaattgtgttagtacgcatattctcactcataggtgggaattgaacgatgagaacatatggacacaggaaggggaacatcacactctggggactgttctggggtggggggaggggggagggatagcattgggagatatacctaatgctagatgacgagttagtgggtgcagcgcaccagcatggcaaatgtatacatatgtaactaacctgcacattgtgcacatgtaccctaaaacttaaagtataataataataaataaataaataaaaagaaaaaaattgtgttagtaataaattaactgtagcttactgtaactttataaccttttaatttttaactttttgactcttctatgataacatctagcttaaagcaaacacatcgtatagctgtacaaaaatattttttatattcttattctataagtttttttctatttttagaattattattttttacttttttaactttgttattaagaactaagacacacacacacacattagcctagccctgcacagactcaggctcatcagtatcattgtcttccatctctacatcttgtcccacggaaggtcttcaggggcagtgacacatatggagctgtcatttcccatgagaacagtgcttcttctggaatccctcctgaaggatctgcctgaggctattttactattaactttttttaaaaatgagtagaaggagtacagtctaaaatgacaataaagtatagtaaatacataaaccagtcatatagtcatttactatcattatcaagcattatgtattgtacataattgcatgttctgtatttgtatatgactggcagtgcagtgggtttgtttacaccagcatcaccacaaatacgtgatgactgtgttgcattatgatgtagaaagcccaaatatcactaggcaatatggatttttcggccgggtgcggtggctcatgcctgtaatctcagcactttgggaggccgaggcgggtagatcacttggggttaggagttcgagaccagtgcgtggccaacatggtgcaaccctgcctctactaaaaagaatttttcaactcctttataatcttgtgagactaccatcgtacatttagtctgttgttaactgaaatgtcattatggaatgcttgactggatactaatatgaaagtctattatttaaaaaatttaggattctcatactctaaaaagtcactatccatatttctacagtttgaacttaaattgaaagttaaagctctaccagtaggaaaacaccagctagtgacctgaccatttataaaatttggctccactcaaccgcctccatgattttaggttaccgtttatttcccatccatctgatcagtatctttatcagtttcttgctgatttttaattttctcactcatagtaattttatttacatagtatgcatttgaaatagaatgagaacaaagcactcccaattttctctagtgaccaaacatgataaaacacaaaccaggatctattaaagtaaatgagaactcgagactctgaattacaaatcagaatcagtaggtcctgacttcatcagtctatagtgttctgttccagcattcttttgaagcatctctcttggaataagcccccaccccttagtctcatgttccaaattcattgttatgtgtacacattgacttctcatccctaatagaccatttctgtttcttcatttgttcatgtagtagttaacctgttgattccagacacttccctcggttatgtgtgtaaattgtgcaagccactggatgtgcagtgctgaaagtgggtcacctccttgatagtggggggctggcattgccatacctcctgccccccagccagagccctctgtgccttgtgagagactctgatcgctctcctgatatactaactcttcaccactctcctctcaccttgtgtatttactttctgactcacaccattgttccccaaatattgtcttccttttcctatttatacccttcttcatgttctttcctcaaagaagtgtttcctgtcaaccctcacagtttgccagtattcaacaggttgaaagagaacaaattattaattttttaagaagcactttaaacagaaggtgctttcagtttttcaaaagattttcatagctgataacatacttgctatttgctgtgtatgttagaaaatagattgggagcaaaccatctattttatttcagttttgtgttattaaaaaataatcatttcagcctagtgttttaaggcttttcagaaataatgtgaaataatttaatattactaagatttagggttgtatgagttcatatttatgggatggccttgggcttgagggcatttttagatgagttaattttttgtaatctgttttatttatacatatactgtaaatgctttaattcattgttatttttgctttaaacaattatcttttgaagaactaaagaaaaagatatagtcttacatttgcctctgtctttttcttcttataaattgggatttggcaacctttttttgtaaggcacaagatagtaaatattacagattttgtggacctcatagtctgcagtctttgtcacatattcttcttctttttttttttttattaaataaataatgcatgggcactacagaaacagcgataggctgaagttggcctgtggaccatggtgctctgtcccctgctatggtgcttatttccatctgttgtcattttccatcagcctgaatcagccccttttagcattgcttataatattggcaagaaattgtctcaacttttttctaaaaatatcatcactttgctttactttcaaagggtaatttggctagatatagaattctagttagacatttttaaatcctgttgcctcgctgcttctccctccccttcccctctcccacttcgtgcccctccctttcctcatctctattcctgttttaatctgctggtttgctgtgataggtctatgtgtagtatcctttagagtcatcttccctgggttcaccgagcctcctggatctgcaggctgatattttcagtcaagtttggggaatattcttctattccctttttccagctctctcttctggagctttcgttgcatctgtgttagattacatgatatgattccacagtttgttcatttttttcaggcttttctctgtatgcgttggttggataatttttgttgacttgtcttcaagttcgtgactcctttcctaacggcagtgccctgtctgctgttattctcatccagtgaatttttatttcagctattgtacttttctgttctagtatttccattctttttagagtttctatatctcttctgaaatcttctactcttcattcattctttacccatcttttttctgtaaattatttcctatatattatagttattttacatcccttgtctgctgattccaacatctttgtcttgtgtagttcttattctttttactgctttctctgtgtgtcacatttttgtgatttgcgtgcctaataatttttaatcacatagagaacaatgtggatatgttttagaggctctctattgtcatctgcatctgaagattatcatgtgttttctagcaggcagttaaattactatcagattatttcatagactggtggaggcttgctttgaggccttttagagtaggtctgttgagttgcccgtagtctgaagtttcagtggaaatagaagatgtttgcttggctactctatccctggcaggacttgagttcctagctccttgtcccccatattgagtcactgctgatactttgctcagttcttccagtcttcctttgggtggctttactttgggttccttgtcttctacacaagcagttcaaaagacagccaaggatttgagggtttgttattagattctagactccctcctctgagtctccctcttttctgggatttccgctcactgtacctacctcctcccaatttccagctgccccagaccccatctctgtgtcctccagctcagtaatactgcttcctgcctcactgttcctaggggactggccgttgccctgggggaaagaccatttaaatgtggcctcacctccttcgcatctcagcctttaagggtcaacacatctagtttctgccagctcttggtcactctccagcactttcattaaaaatatatattttctctacatttttattgttattagaaggagggttagtctcatataggctattctgccattaccagaagcctgagtcctaagtgagtagatattaaaatcttggggaacctttgccatccagattttcatcatgttaaaggattaagacactctgggaagcctcctgagctggcaggcggaaaaataagatggtgctgggatccttttggttggtgaatttgagtgcccccggttggctggcagggtttgtgggtgagctggtgagaggtccctgcaccacacactccccacctcactactgctgggaacaaaagtagattgattggagtgggtgtgcaccatgagagctgtacatcactgttctttcttccttgtgcatttgtagaaattgcattgtttactgtatgttataggtacttatgcatgaaaacattttatttgattaaaatattttcatctccactaaagcttaggttctaaaatgggggatactgccttactcaaaagttggcacatggccgattctaaagatgatgtgagtgtcctatgccaagcacaatgcctgatgcaccgataccagtgattttttctttcctgtctactctcttccactctatgatagttgttaaaaataattggattgggaaattaagaaaaggaaagattatatacctactttttaaacttatttttccgtatggcaaaataagaatagtgtgtactagtaagagctatattactatattatttggggagaaatttaacaactgaaaaaaatgaaaatgagcagaaaagttagtgttcaatagcaccataaaaatgtatctttgaatcctcattcacagtgcaagaataatgatagtgtagtgtaggtctgtagcaggggttcttgacatggatttaggggtctccatagatcgctgcagtccttaattgtatgaaaaagtgtgtgtgtgtgtgtgtgtgtgtgcgcgcgcgtgcatgtccttgtctctctttctgagagaggctgtacgctggtcatgagatttttttttttatagagatcttttgaagttttattctttttaaaaaattatcacttttttaatagaaaaagtgatggatcagtattggagtaggattatgaagatgtaatttataaagatagaaagaatgtatccatgttttcttatgtcttttcatgtttgatagtatgtatgtatacatacacaaacatgaaaaataacctggaaactaatgtggtaatatgttaacagtggcaaattgggatagttgaaatactttcttcttgtattagatatcgtttaaatttcaaaaaccaaagttaaatctcacaagttaattagttcaaacagaaaagacagtaaaaaaagtacagtgaaacctgtgtctttctcacaccgcccctttcctcagggctgactgcagcagtgacttgtgtatcctttcatgcacacgcacaggcacgtagacacgtgcatgacacagatggaagtgtaccatgtacattgctctgctccttgggtttggcgttttagattttgtatcttgaaggctttccaattttcagattcttaaaggggaggtctttgaccctatctcccaatcccctcgaaaggaatgaagaactttggatgtctagaaattgttttctattctgttatccttttcagctttggtgtgtgcaaacctgactcctagtggtagttcagaaattatttcctttcctttgggctcagatgatttttaggggcagtgaccttttgaatgcccactctgcgctggcctttagctgcttcacctcactcgtcttgcactgtcacatgtcatttcttgtttattattactaacactacaacaacacgtgttgagtttggtaatctttcagtttttaaaaaatttcagattgggccttttttttttttctaaacttcattatggaagttttaaaatgattacaaaatagaatagtgtaataagcctccatttacctatcgttcagcttcagtaactaacagctggtagccagtctggttgcatttactactctggctacttccaccctcccacattgctttaaagctaaccttggggatatcatctcattcctatgttttcattatataagctccaaacgataagggatatcttttcatgtcatcacaatacctttgtgaaacaaacaaaaataaagaagagtaatttccttaataatatggtcaaatatcctgtcagtatttgaatttccagttgtccccagtagtgtaattttttaaacatttcgttagaatgagggcaaataagctccacctgttttataagttgatgtatcttttgtattcttttgatctgtgggtaccctttccaattctcttcttgctttttttgcaggttatttttgaaaggaactgagttgtttgtcttatagcttttttaccattggtctttgttttttcaaacagtcaaatatagaaatatgcttcattaaagaatattaactgattgcttttaagtttttagatattctttcaatatcagattatatttgaatatacatttgttgcctaacatatctctgtttatggctttgacttgtatgggttactaattaagcacatgtttattgatttgaagtagggtatactttttgaaataaaaactcacaagaaaaaatagttcaaaatcagataaaattactttgaaaacatcttagagagagagatgctgttttagtctgtttgtgcttgctgtaacaaaacacctgagactggataatttataaaggaacagaaatttctttttcacagttctgggggctgggattccaagatcaaggtggcagcactggtgagggccctcttgctgtgtcttcacatggaggaaggcagaaggttaagagaaggacaaaccctgtgtcctcacatggctgaagagcggaagagagtaaacccactcctgcagtccttttttatatcagcataggtccatcatgagggtggagccttcatgacctaaacaccgcccagtagaccctgcctcccattgctgttgcattgtggattaagtttccaacacatgcattttggaggggacaaaaacatcgagaccacagcagacagccatatcagtgcaacaggtagtgagtgaatttgtctgccaaatttctgattggggctgaaggaaagagaattcttgtttcacttttaattagaatatagtcagctacttaacgttacatgagagaggccttttcagagtctctgtgatgtgagcatagattacctagagtaagttttccgtagaggtggatcttgctggagggatgatgtatatcaaataggaagccagggccctaaactacaacttacaaagccccaggaggagcccagaaacttctcttactgacagagttttcttcctaagtgaattatctgaagcattgtgaacccgagtcatatgcagtgaggcctcaattataactggattatgtaacaaaaattcagttttaaatctgtggtttggtgcccagaccacatttgcccttagtaataatgtgtcatatcagattaggttttcagcatagcctgcaaaaggtatttaatttgcgatgtacctgactattgtcactggcaatacagagctcatcctgctaacgtcatccctggtggcgatgccattgtgtccagagggacgctttgttcagggttacattcaagactccaggtgggtgctctagtgccatgggatcctggacaggagctctgaagtccttggcgtccttgtcataagtcatctgcacttgtcatctttcgtaggcatgtgatggggaagtgagagcttcctgaagtaaggagccttctcagggaatgtgtgaaacttacaaggggaagatggggctggagatccaccagctgaaggtgccaacacagtgatgataagtccggtgtctggggctggaaggtcttaagtcttagctgttggtttggtcgttgggtctatagtagaaaactgaagcatcagtatattatttatctcaaattgacatctaattctgttgagacttctagaagaaatgtaatggcattcttccctttctcatcttctgtgcctctcagtctccctcttcttactcaagagggggttggacagttattttcactgtttcttttctgctactcccacattttaaatcttcatcctttcctttttctcttagagagtatggatgtgtttgtatctgtagtaatttgagatcacagaatgcgatggagtaccatcttgaaaagaggctatatcttgcttgctgttgtatttcccccacagagaattaccaattctggaaaggattacaaaagaagaggacattgtttaggtaagaagatggtgaagaagaatgcatatggcaagttaatgggacagttgtgaatagtgactgtaggattaatatctgacaggcaggtctgttgatctcaatactcctagagaagggatgtgaaagatgccaagcaaagcattgactcagctataatagctaaaaaacatagtcactaattgacaacttagcatttaagaacgtctgaaagaatagtctcggtggtctgtgtttcgtttgacttggtccgcattgtcaggcttggtgctgccccgtctctgttgctcagatcctctgccccagtaccagtagaccaagcttttctcagaatgtgtcttgttccaacagaaccagaaatctgaaatatcagaaaggatttgctccaacacatagtacagttctcatggttcctggtctgcagtgagctaaatgcacaaggcccaggaaggggagcggctcggatttggagaggcagtcagagttcactacacttagtggcttagtttctgtgtttttgccccaggtaatagcagcaccttgtatctgagtcctccttaaaaaaaaaaaaaatacatacatatatatacacacacacacacacatacatatatatacatatatatacacacactatacacacatataaacatatatataaacacacacacacatatatatatacttttaacatttgttataggggaaaatggatgtaattatttgctgacaaggggtggggtagtggcctgcctgaaaagctggaggagcatgccagtgagtttgttttgttttttttaagtctttgagatcctgggtctctcccaaccatccgtaaatctgcatccttagccccaaattcagggtgtggatgcatgtgcccgtgtgtgtgcgtgcgtgtatgcgtgtgcatgtgtgaatccatactggattagtagcccaagttcagtggaccctggcgtgtagcctctcagggtgagaatactgtcttgttcttgctctcccaccatggttacgatgactacctccttccattcgctacatcagaaatcatccagtgggaagaggaaaccaatgttgtcatactctaataattatatccatcccacagtgggcaacatattttgttgtgattattagaaaactatattattagaaatatgtattggaaagcttatcaattttcaacatctttataacaatagtttatatatttaaatagtttttgtatcttcaagcattaaattttcagctgggaaattatgttctagtttagggctgacagtaataattattagatctatttttggtttaatacctattaaaaatataggctctggctttggattttagaggtataatttaattagacattcttagccatgaagtgcacattgaacttttccttccttatcttcctcagtatccactaacatcagcagcagctttgataaggcagacagatgctgctgctgcccctggtacttgataaaatattgcttcgaagagctggctgataagacttttctcccttaactacttgcattttatacaattttgaatcttgaccagataatatctgtaatttagagaacattgatttgcaaggttggccgcatgttggaatcacctgggaaactttttaaaaggctgatttaattggagtggggtgcagcctgagtatcaagatttttaaatgactaatattaggtgaatcaaatatgcagcaattatttaacaactctgtaatagaaattaatacaacaaatttgattcttgtccatggaaatgcaaattgtgcctggtgaagatgcaattgattattgccctgtggatgttgattattttcacataattaagcaaatttattttgacattcctgatggcatctatctatctatctatctatctatctatctatctatctatctatatctggtctttgaattctcctttgaatgagttatagtgtcttgctgttttattaataaatgagttaaatctttaaaaatatgcagcaaaagttgggttttactgttttaggggatgtagaaagggtcatcaaagcaggagctaaaagagtggcactaagagaatcatccttgggctaagttgatttgacacctgtctaaagaaggtgcttttggacttttagctcggcccctcacctgggctcctgtgggctctgaaatagtgtgaggttttcggaaggagactttgggagtttgcttttatttttacttcttagggaatgtgtgctcaaccataaaagacagtggtcttcctagcatcttctatgggtaaaaacatatttagtataagggggaacttctttcccccactattaaaagtgcagtttaagggtggtggtctcacaaggctgccaaatgaaaccaggtgattgatatatactgtatgtataaataattagatatgttaagagacaaaataatgtaaaatccttagaaggctcagtgtaacacatttgttgtgtgtctgtgtacattttgttattttcatggtctgttttgatatcaagatggttttcataaagaagaaacaacatttagttgatctatgatcttaaagtacagtggacctcatatctacttttctctttgaacttttaaaagtttttttctgtatcacaatggaaacatgctttctgaaaaggataagtgaagagttttgcaaagggcagaccataaaagtgtagcaagatgaggcatttcacattttaaattttattatagaatgttttgttcctaatcacctttgctattccacagctcattatcacactagggtagacattgttcatgtccatttaacttttatctctactctactttgtccataaccactctggatcttctaaaaacccttgaaccattacctataaattaattaaaacctgcagctccctctatctctgggcgctctgacttccagctcccccctcctattcagccatctgctcttggtacctgtgtcactcttcacactgcctttctagcctctatccatcctgtatatttggtccatcagatgaactcctctctagcaccttcatctcactgaattttctgtctttcctcctggaaatatccaaacgtggcatcccttctccacttcttcatccgagttgccaagctttgtaagagtagatgaaaccgctgtgcagattggagacaccaaaaatgcatggatttccacattcacagattgcctagttcctgttcagcagtgcttttgtcctcacacttggttggctcctgcgttcccatcagtcactttgccatgtttttactagtctctgtagccccttacacactcactaaactcctttttctttgtagacagcgatgtctcttacctcaatacagtggaggcagttggatatgaattgccttaaattcatcctttccactagcagacttttcctttcacctaacattccttctgtcctcttttccttccctctggcctcagagaacagcctcgagtcttccccagttttaaaccaatgctcggcctggactcttgatgccctgctctgctttctccaaaaccttgccgctccacacctcttattcttcttgtattttcactcttcttttattggctcctcccactgggcctatgaacatcttggaagaacaaaacaaatcaaatagtcaaaactgttttcctttgaccctgtgtttctctatcccctgctccttcgcagttcactctcattttaagctcaggagtttgtaagacagttccactttgctttcttctctcccctctctcctctgtcctgtcccataacttcctcagcccacttccctccaggcttccccataccctgcatgcttcgggaaacaccaccagtggcctcttaatcactgcattcataggaagctttttcagtccttaccttttgcatcctctactgattttgacattgaaatgctgttctcttgacttctgtggccaaaatactttctgttctccttttttaaccattccttttttacctcttttttttgtgtgtttcttttcctctacttgctccttaaaatttggaactacttcccattctgccttaaatggagagtaattaacccaacagaaccacttgtcaaagcttaaaagaatgtatacagtctggggtgtcattcctggagtatctgattcagtatgtccttctagaaacctacagtatcatggctctgtaatattctgtcatatgcaggtaccataaattatttaaccatttcttaaatattcattcattcaacagatattcattgagcaccttcaaatcccaggtgctactgattattcagtttttgtctgtcatgaaaagcactctgataggtagcatttgtttcacttctttcatagtctcaggatagaccggattactctattaaaagatagggttttctaagatcttgatacccgcggtcaaattttttcatagaaagccctatttttgcttctaccaactctaggctatggttttaactgccagttatgtaagaaagtggctcctgaactctttaccactagactctgctctctctagattcatgtatccaaactgctttgagttctcaatgaacttgcctctttgcctttccaaaccctaatgcccctctacctgaatgcccttgactctttggatatagtcactgcattactgcatgcctaggaattgcttatttatttccctaagttcctgcatgcagggttgttcatcttcgagtatccttagtgccggcacacaggagctaatgaatacatgctgagccaaatggactatgtgtgtaaatgtttccatgttttaggaattattctgtagttttctgtatgattggaacttcgcaatttggaatctatagccaacattttttaaaagataattgagcacattgttagcttttattggatttaaattacacagtttatattaagatatgtattcattataggtactttagtaattggagaaaatataaatggtaaaatgaaaactgcctgttaatgcactaccttcagatacccagttggccttcttcatagacatatgagtgtatatgtctgtcaagtgtgtgtgtgtgtttctgtacatttctacacattcatcttcatggcgcaaaatgtttagaattatgtctttttaatataatatatgttgagcattttccatcaataaatattttgtaaaaaatacatttaatggctaaacaacattctcttgtatagaaatatttaagtatttgtttaaccagctccatattgttttgtatatagaattcctgccaagttattattaacaaaaatgctggagtaatatcgcaatagcagttcatttattagacaactgtgtgtcaagggtctagtgaccctggcaactatgtgctctgtggagtaagatacagtttgatgtggaaagcaagcaaacagactctcagaatatgctgtgaggaccgctgctgctctagggttaggaaaagaatgccagggacacagaggagtttgagggagatgtcagggaaggctgcctaccagagctgcaggggaacagacaacatggttattgactgatttctttgctcaggatatttgttaggataacacttggttagtatgatgaagaatatccttttctatgtaatattgagggttttttgaaacattaaagatagatacgatttaatcaagtacatttgggacattatttaacttatctttactctccttccttgacctgttgctgtgaaaaattataatatgttgcttctgaatattgaaatagctttgcttcctattttctgtgaatgtgcttcttgatatagattgttaaagctgtgttcatgtgtggtgttggtttttctgcccctgtggctgggtttggtatctgaggcatgccagctgtatgaaatactgtagaatgccttctgtgttatcctgggctctggagcagtttaggacatgctttattctttaaaatttgaaagaagttgataataaggttccaggcccagtgagtttttttaaaaagcaaattcagtgtaatgctatggcaactctctcagctttgtcagtgctggttattctggtcaagctttcctcattctggatcagtttgggtagttgtgtgtttttctacgattttactagttcatcacaattttcaaattcattagcacagagttgagtctttgatttctttttcacttactgcaggcagtgtttttgtttgaaatattgctagtctagactatcattttcagcattataacagcgtgtcatcttcctcaaagacaggtaagtccagcggtatttgagatgtgaaactcggaggttaaaatgggttgattgtaaaggtgggtttactcagtttacttagtagtgaagactaggaataatcttcacttacaagagcatgtataaatggctgtgtgtgctggatacaattttaattttatgccattgtcatttatttagtgctattgaaataacacttacagttcacagtaagagtaaggtgcttgcactggcatataatgagaggaagtaggaattatgtttttattcagtagtaaaaatagtacagttacatatggtgatcttttttcaatcagatggtacctctgtcagtaaacagaggtgccttttacagttcattaggatttacttcataaaatgttaccaatgtgagttttgaaggctaaacgaagagggaggacgtacgggtgctagcgcagaggctatatggtacccagcagaacagcatgagagaaggatgagctgatagaagtaggtgagacatgacttaaatctcttatagatctaagggagcaatagttgactcgagtgctttcggggtactgatacagcttcccaaatgttgacataatttataatgttaaagatgataaaatgctagattcttaagtgaaaccacgcagtgccagttttcagtttgtgtgtaggtgcttttttctctttttctcttcagaatgcaggttctgtgtcacaggttattgtcttgtcagtgtttatatgatcagtaaaccactcagctccatctaattgccattattactaacgattatgagctatgcagctctagagaaacagggttctgtgcacaacgtttactggtggtacagagagagtgatgggctctggacaagggtgttagggaagtttgcccagagaagccccatcttgaaaggacgccccacagagaagggacagtgtgggaggcaccttcagggaagaggacaaagcaggggttaagtcctagggtctggttgagcctggacttcactgtgcctgatcttgaagagagaacagaagtggcaaagggcaaagaggtaactagattacaaagaacctcgttaaccacacaggggagtttgagccttatttatcatcaaattgatattaaaatgatttgtaaggatacactaaagtaggagcccctctgggagggcctaatacctttttccctgtaactgttcacattagacctgacacagagcaggcatgcaattgcagtaaaaacacagcattcattgaaccaaatcctaacaacttagtgggctgctcctccaacctgtgatgcattagagcccaaggctcttggggaatgagaggcaggcctctgagatggtgagggagaccctccccacacgcactttagcatagactgaagaatggtcagagagcaaggggctactgtaaatccttatttgaagattatgtaatttctataaatgatttgtttttaattcagtcttcttccagaaaccctaaaagaaagattattatttcttaacggctctaggactttttccttttgttcagtggtttcagattatgtttcactaataaagagacttcttttatgattatttgtgagtgttgaaaatgagatatttttgcatcattttcttacacaaaatttttaatttaaggtatcacacaagatagttcttatagcctttatcattaacagtttctgtgtatacatttttaatagtatacatttttaatagttgtaggacaaaaatttagtctatactattagttacttctcttctagcctattgctgttttagccactggcctttctggatcttaaagattacagatccattcacgtgtttgctgggatctttcttccaagtgatggctcctccaagtgtatttaatgtaaaaattgaatgaattaagattacatgttaatttaaatacagtaagaactcattatagtaagaatgcatattatgggcttcagatttactgacgtggtatgagtattctttttgtttgtataactatttttatttttaggtaacagcaacagagaaactattatttatttctgaatgtatagttctttgggaaattgttaacccagatcccagtggtggtgggagggcatgatgggggatgtcttagagtctaacatgccatttttttccctttgctccccctcccctaaatcaagacttacggtgagagatgtgattgctggggagtgttacccttggtaaaggtttggcaaaaaggatgtgttggaaactgcctcttatattgatgaacttaaagctgtagctttagagtctagcaggcagccctgaaattaatgtagttgagaaaggggcaggatttttcatttttaatagggaattacatgtatgcataatatgtatgcacgtgggatattagttgaaatgtaaaactatattttttctctgtcacggtgaaaaaatataaataacgctttacatatcagtaaactgtcttgtatgaatcagttaagagcgtgtagtaaatgactactttctttgtaattttggagagtgtctttaaaacacatcatatttaccaggagaattataaaaacacactaaatataaacaggaattgtaataaaacttgcccaaagcaaaagcttttataatggctgttacaagctaattggagattgtttacctattgacgtggagctataggtagaagcatttgaggaggtacttattatatttattgtagtagctgtcctaaatcagtagtctaaatttatatactgttattatcaagataaaaaggtaacttagttgaaaattttaaaagcagagactagtattttgtaagcagatataaacaagttatttttgtaagagttttgttatgttgaagtgcaaacagaaagtggccaaacttcaattacttaacaacagctattctgtaagtatttgttaatcatgagttcttgttgctttaagccacaactgattctattaagaaaagttgttttgattatataatgcaaaattatgtgcacataaactattaagcacagttgttactactgtgaatatataatacatatatattatttatgattcttaagtttgggtgaattactggcatagaaataatagtgctttggtaataaaagtccttttacatgtttttcaagtactatatgttatgtgatttgtttattatttatagtttgaaaatctgcaggtaattcatgtatttcgttttttaaaagtgggtcttagccttttgttacttacactgtgttaatacggatttcatgcaagcattccatatttttctgtctgaagcaaaactaccactgagcacaggatccagtttctgcatttaatgtgtgtttttttccaggactatttcaacttcactcatcgtttcatgagcagtaactaaagtttataaataagaaaaattgtcttattccaaagattgcctgtactactctcaaattatattctggatctgataattcgcaggaagcaaataagacattgctgtgggcgatacatttatcaggatgaaaatttagttatttttgactattgttgagatgtaatgtcctatatttcaaactagcttgcttcctttgttctgttctcccactttgccttggcaagttggatcaatatgcaattgaaagacgtttgatctgtaaatagaaggttctctgaatttcttggcctttctggcaagatagggagagaggcaggtagatcagagtttgaagggcccatggtgtgcggtgtctgccttttatttatttggagtaggataccatattggaggttacatcttccatggccagtgagcagcggtagggtcagcattggagacaacttctgagctgatgcgtttatttaaattgtacttacacatttgggatatgtagaatgttatataattatcaatattgtcttcagttcagtacaaaatagtaccctgggaatttgttccttttgccattttaataagtacctagaccagtgtgttaaatttggaatcgattactgcccatgtcatgaagtatgtatatccttataaagtttaaattaattattattgaaatagagcatgcacatatttacaaaatccagttgtgcccagagccccaggtcaaagaacagcaggagcaaggcactgctcccaattctcttagttattgctcctgggttacatctgtctgacaaaactgtgcacatgtgtagcagttctgcagtgagttgtgtatagtacctcttgaatgcagtactctgtcctcatacttcatagatgctgtcagctctatgctgccagcaagggatatagacactttctgccatgccatatttcagctcatcctcgtctctgtttttccatccttttctgtcttctgtcttaagtcttagctttgcttaatctggttgtttctaagctagtaagcatttgttatatctctaaaatccctattaggtactttgtatgtaaagatagtattatttttagatactttgattagatgactagacttttaaagctgtagttcagtatctaaagtgtactaattatttgcattatggaaacatttattaattggaaatagtccttgtgactaagaaatgattaaaattatgaatttaaaagggaatatatccttcaacagtttatacacatctgtatcataatttattcaacacattttttactaggtatctgacactgtttaaaagtagtatgtttgctttactgtactcttatttgtttaaggtaaattaatttataaatttttctctgtttttcttagacaaaattgaagaagcacaaaaagaacttaatggggcagaagtttcaaaaaaaggtaaattaaaatcagcttgaatgtaaactttattcttgcaatgatgcctatacatatacctcataaatgtagccttatgaaataaatcagtatagacatatcacaaaattagaaatccccttgaacttattgatacttaaaatgttgtggactttgcttcatgaaacattttagccacatagcacattctataactgtttcccacatattaatgtatgactggtagaagtgtgaaaggttattgcagctcttttgaaagtcctgtttgtgagactgtcctgtagcaataaaagtaccaatataaggaacacagttggccgtgtccatgcatgtgtgttcatgtgtgcattcatgtgatgcagttttctttttttttttgtagcgacaaaaacctaaggcaactaaaacagcctgaataccagtcagtggaagaacagttgaatcatttgtagtatactcatattttggggtatcacgcagctttgaaaaagtgttaattactttagttgatggtgataacttatcaaataagaaaaataacattgcaatgtagtatgtaaaatatcttatttttttgtgaaaactaacaaagtcaagtgtgtatacaagtatttatatgtatatatatatacgcatacacacacagaggcttctgtgagattggacaatgttggaaaggatttatacacagatatgtgttaatagtgggaagaggagcaagggaagatgacccactcatttatatgcctttgtattatttcaccagctgcaatgggtgtaattttgtattaaaattaaaaacttgaaaggaaaaaattggttttcaccatagaaaacatagattatctttccaagtaatataaaaaaatagatgtgatgcagaagagcatgtagggatggtcaggtagtgaggtaaatactgttgaaacactatctgttaatgagcaaaattgattatgtgcttttaatattgtgggcaaataaagttctctttatgacatttgtattccgtgatttattatttattttgccttgtatcttcaaattacagcagactattttgacagagtaatttagctaaataggattccagttgaaagccgttttacaaaaaatagcttttaaatctagttagactactgagcaggtatctgtaggggaaataatttcctgccatcccagttctccatcccttaaaccagcctgtgaagccttcaggatggtttggggttggtcttacatttatggggtactatgtagcacccctcatgtctgccttctcctcaccccacgctccttccatgggagctctggaagggccatgtatatctgaccctctaatgacattcttacagaaaaacaagcatagaagagtaaagatgtctccatggccaccttgtccctttgaagggttgactgacttaaacgcatgaggcatttgagacactcaggttataagaggccatacttttaaagttttctttctctatagccagccttttttttttttttttttttttttacatctagtcatggtttagagctgcttctagtagcaaagcaaatgtgagcctgtcttccttttccttgttacttctttggcaagagttttcagaacagtgaactaaatgcctgataggaaggaggaaatgaaacaaaggttctagaaagagaaattggataatgaggttcagaataatggattgggctacagttggcaggctacacttatttaagagctaggatgaataccaagtgagcattgttctgtgcagttcactgcatagaattactgcttggctttcatttttatacagaaattaaaaataaaatagttttccctttcaaatataagtaagaaataatatcagtttctctttaacaacatgaaaagtctgagtaacagtggtgttgagatttttcaaaccttttcttgctgatacctattttattttaaaggatattcatttcttccatcaaagaatatactttaaaaatatagacgttcattttagattatggtaagtcatctacaatagatctctttttcattgtttttctgacgtactttgggttttttcaccctgtaagtttagccacattgctttttaaaaaaattatttttaaacactgcttgtagttctaaggctttgtctccattaaaggttctgtggtctttaacttatttgaggctctttctccctttctctcttttttgtaattattaggacaagtaactaatttattttcagaagtatctagcatagtagtaggctcttaaaagcaacttcctcattaatagattaaaaaagacatttcctcttgtattttaataatttaaggaggattaaatctgtttagtgtaatatggaagtaaagaaactgactttgcctatcatacaccaatagaataaagaaatgcactaaattatgttaatgtacttattttattctttttctcttttgaatgaaaatcagatgactttaatttgatttattttgattttaatcaatttagggatagagataaggatgcaacattcacacaagtctccataaagtcattatgtttttccttacagtgctatctcctgattcttaacacacattgtgcttgacactatttttaaaattgttgagtgggatttaaatgaaatagtgactgtcacagatgtggtaatggaatatgaataaaattaactgggaagaaataaatagatcgattaggagagcttttatggctttctcaagctttaattttaatactcttaaatttttatcatacaatgtttgacacatataaattaatatatgtagcatattaaattacaaagcataagaatgacatggtaatctttgattctcacacccaatttaagaacgggaatgttgccagtaccattgtatccacccacatgctgatcggcaattcatcccattgtctcttctgtagaggttttactgtccttagttttgtgttcatcatttcagtccttttaaaaaacaattatgtcatataagtatgtacccccaaacaatatattttctagttgtgcctgagtttgaacttttaaatgaaaccatattgtacgtagtcttctgcagcttttttcacttaacgttgttcctaagattcacccatgccgttgcacatagctgttacttttcattgttgtaatattgcactgtatgaaattgttggcccattcttctgttgatatttaagttatttccacctttttgctatcataaacaatgcaggtatgaatatttttatatcctagtgcctatgtgtgagtttctagagcatatatagggaatgtgaatgttcagctctacaaaatgatgctatattgttttccagagttttttttggggaaactttttgcattcccactatcagtgtccaagaattcattttgtactatcaagtacatggtatgtttagtcttttttttcctaattggatagatgttaaatcctcttttattctgctttgatttttgtttccctggttactaatgttaaaagaaaaactttagacacaaaaagtttaactgattttatttaaacaaagaatgattcatgaatcaggcatcattcagaaccagaagaggttcagagagctctgccgagcagtgtgagcagcaagctcgtacaggctgaactcgcaagcaaagtgagaaatcacctgattggctgcaactagccacctgccttgttcaggtagggtgtgatgaagtatttgccttatttgggcatgatctgatcagttgacttcctgtgattggctgaaaagtagctattttttacaaaaaatactctaaattaggtttgtgtttgcgcactaaatgaggttgtagtttgttaggtcataactcgaggtaaggagacagcctcaggcaaatggcctcctgcttatttaatttaataatgtcaaacatgtcttcatttgtattcccccttactgaaatgcttgctattattatttgtccattttgtaaaaattgagttatctttttcttaatatattttgaataactattcattttatgtgctttatttttcagatttattttttacttcatttaaagtgccttctattcactaaagtgaatagaagctcttgattttaatactgtcaacctattaatttcttgattttgtgattcatttttttgtatttttatttgtcttaaattcttctctatcacaaggtcttaagtatatatatatattttctatattttcttctaaaagactttcacgtttcagattaaaaacccatctggagtttgtttttttaaaaaaatatacctagttttttaatgtagtgtaagttaggattcaagtttcttttttttctcaagtgggtaaccattgctaatattgttaaatgtccctgaaacatttagtatgttttccttttactgtttcgtattaatttttcatttttgtgtgggtttgcttcttagctctctattctgttctgtgaatttgtttacccatattttaatatcacagtatgttaattacttaccactttattgtcttgatatatacagtgtgcaataactagtatatactatatacagtagggcagattccttgtgttatttgccttcaggaatgttttcactatttctagtcctttgctcatctatttgaattttagaatcaggtctttaaaaaacttgttggaattttgtttgggtttgattgaatctggggcaaactgaccatcttcacagttttcaggccttctattcaaaaaagattgtatatttctgatacttgtgttttctttagtgtcttatcattttcctccatatgaatctttatttttttctgctctatttcttagaatttggtgttttcctcattttaatgattttttcttttgtaaaattgttttctagttcctggcaaataaaaatgcaatatatttttgaatatttatttttatatccagctacttggctggattctcattcattatgaaaattgtctgctggtgttttcagattttcttgtcatatcagctgggaataatgaaagtttgtttcttcattttgaaataattgtttcttttatttatttttcttatcttgctcagttggctccagtaaaattggtatcttagacttgctcctgattttaaagaaaatgcttctaatttttcaccattaaaatgtttgctatctttttttgtgggaagagagtctgtatattttttagttgcttaaaggtgttatcttctattttttatttgttgaaattatttttaaaaatcataaatggatttttatttttatcaccttttgtttctatgtaaagatgatcttactatgtcctttattctttcattctgatgtttaaaagtgacttacgtatctttaaaccaatttggtcatgatgtttaatcttaatcactgctagatttgatttgttaatattttattgaagaattttgaatccatgttcaaggcattggtttatatttttattatgttttataattttctgtgcctgattttgttttaaggttatgctagtttgataggatgatctgaggactatatgcttctgattcccatggagctgtttgtttgatattggaactgtacctttgtaggcaagtcttacaacatattttgacttttgggagggactgcagggtagacttttaactcccaagtgtacttaacaataagggattatccaaacattctattttctcttcagttttaggaagttgtatttttcttataatttatccatcttatctaaacagtcacatctgttggcaaaaaatcagtcgtagtattttcttactctctttcatttctgctgggtgtgtagttatgtctgttttttattgcttctatcattgatttgtgcctctcctcgctttcttgattagtgttgccagttttctgttttactttctttttattttgccaacatctgattttcatgatactttcttgcctcatcctttttagtttcattaaattttgttctttattatcttttcctgtctttttcttcaggtttgttctgttactcaaatttcttaacttggaatgctcattcatttttaagcctttattctgctctattggaatcacttaaagctgttaatttccttgtaagtattgcttagatgtatcatacacaattttatatttattagtttcattcttttctatgctggtttcttctctgaccctccccccaccccaaatcatgttggaatttttttttctccacatggatggggatcttatttatttttagtaatttctcacttaattgcattgtattgttaattgttttttaaaaccatttaggatatccaaaattatttcttctctgtttctgaataccatgtaatcaaaattttctgagaatgtagtataaaagtactcatagattttatgttagaaattgagcattttataagtaaattaatcattttgccatgatgaaaaagctgaagttgaataatgttaaataacttaacccaagggagtgcaaccaagaaagtacatgaggaaaatcaagcccatgtcttggactgtgctattctgatattattccctggtataactagataagatctgtgttatagtgatagttgaatttctggtacagttttatttctgttctaacttacctttttgaatgatgagattatgatagcagtcacctacagaaatgttacgatgatccaggataaaagagttaggattcagacaatggccatagagaaaggtagagactttaggtcagcttgcattatgatttttttttaacattattttctgtctcacaataagaacctacaattgccactatcattaccagtaatttcttttcagcagtagtggtatcactcttacattatatacttcagccccagaacatttttattttttaaataatttctgtgaatatcaccatctatataagagtaagagggcctaaatatacataggtagtttatatgagttaagaaatatagtaaggaaaactgttctagtaatactgaatgatattcatatttgctctgaaaagtcagttgataagtgggatttttgttaacataggcatgatttatgccctgaaatatgcttctcttgtctggggaagcttgagggaagttaggttcctgtggaaaatgagactaagtcagaagtgagagtggctccattggatcatgaactctaattggtgtgtcagtaaaaatgctagtttctcgcctacttttctacattaaaaaatgaatatttttattcattttacaatgatattattaaaaaaatataataatatttttgaagataatgtgaatgagtttccaaggggtgaaaaatggtgactctcatttaaaaaaaaatttaattaccacacataacattttttaaaacgaaggctaatttcgaataaatattttatgttaataaggccatgctttattgccaatgacactcttccttaaaaattctgctgagtataattaagaaaatacaaggacatattcttgtaattagggatgacaaagtccttcccatgtaatactgaaatttaggtagtatagtagaaaagatggacagattttattaaattaaaatgaagaatgtcaataccataagagagaaggtgaaaatgttttaaaactgggagaacatttgtacaataaaacaaaacttgataggcttaccttagaagggtattgacaatttacaaaatgaaagctcatgtggatatggctagaggaaaggctagtatagtatttttgtgagatgtctgaatggaattctgtattttaaatggaatgcagttttattattttaatattatattgatgttaactagtttattttttaaccagtgtggtccttgggtttcttattaggaaataatatattttagtgaatctgtttaatagaggtttattttaaaaaacagtatttgtacatcttagtctcttaatgttaaatgccctaaaaattatgttttttccttgtacctctcattaatttatttagtaaattgttgttgtgcaccagccatttttttttttttttgccctgagaaatagataggaaagaaaaagtctaaaccttaaaggagcccgcaagctttaacccagctcttacccaaatcatcataaatcctgaattggtagagcaaaaattcatgaggtagactggcagcagtgcctaacaaatttcccttgggaaaacagtaacagattttttattttttagaaaagaaagtcatctcctttttttactattaaaatttcaaatttaaatattcacatcttacgaagtattctcttagtgtaatagacagtgaatgctgtgagcttgaattactgggaaattagtattttaattatttgtgtcatttatataagttaaaggtatcatgtgttaaccatgtcaatattttgagaaatttgaaaatcccaaatcccaagagatcattgcctttcagatagactgccagctttatgaaagatgatttgcataatgatataaacaaagcattttgtagtacattaatgtaaaataaatgtcttcaaatatctgtcctcactgtgtttaagttcagaatcctaaaacattgctccttttgaaatatgaaagcaaaaattctcagtatttcctaacagtgttacttatcatggtctattgagccattcattagagacttaagtagctaacctgattttaattttataggatgattcatagaaagactcacattcttgtgcatacttatagcatatttcattgacttcaaaatgctattgattgcaagatgcacaatgattttatgcatcctttagcaaggagaaaagtcactgccaattaagttatgacacagtgctcttataattgattagaagatgcatcctgattttagagggattaaaatgttttttaaaatttgtcttacattatattaaatacatatttatgtccactggtacattttttgacaagaaagataaagtatttaaggtaatggcatatggatttgagctgctttgacagaatccctgaggactgtgaaaaacaaagaaatgaatcttatcctagaggctcatttggggattcacggaagagtggtatggggagaaaaacccaggttttgtttgtttcactttgcttcttaggtaattgacttcatgccatatatctgagtattttctatataaataatgccacagagtgacttataaggataatatgtgttgctgttcatctatttaggcttttccccaggtttgctactgtattctctgtatgagaccaaaaagaaagaaagagataagcttgtatatattttgcctacgtagagatttgctctttttctcatgtttcctcagagaagagagcagacatgttgcataaacctgaagaatataatttgagggcagaaatagtagaaaataaaagtgagaggaggcagataaattgaagacagataaagaactgggaggaagtctataaaatgaatttaaaaaattaaaaagcaaagcatggagataacaaagtatttaaccaacaatatggtgttcttttattgcttcactgtgcaaagggtattttgtggagctatgctatatgcaggaaatttatcaaactttgaaggatgtagcttagaatttttccctgaccaccaagcaatggggtataaaattattttatttaagaaaagcgttggaagtagcaaataagattctgtggatgagtgggaagggcaagaagaggacttaaaagcattgcaatgaaaacaaatgtatgtagtaacattcatgcatggcctgatctgcggtgggaggtggactgcaggagcccgaggagcagacgctttgggagtccagcccactgtgaaggagcaggagccagagggaaatgtcactgagttttttttttttttttgagacggagtctcgctctgtcgcccaggctggagtgcagtggcgggatctcggctcactgcgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggcctcactgagtttttggcctggaggagtgtgtttatttcagcaggcccaccccacatcatgtagttagccatttagtaactgtttaacatgacccttatatgtgaagaaaaaacgtggtaacatagatgcaactcacttctccacaccctcaccctctcacctctgcctggggtctcctcacatcttcccctatacagttttgcccacagtcatagcacagcacttactacagttcttagtgcatgtagtaggcatttgacaaatgtttattgaatcgatgatggatggtagaggtgtcagaaaggatggattcctttacttaacaggcaggatttgtaaacagtgcgttattattgctttgatttcttaagtgtggttagatatgtaatctagattgcttttctgaagtaagttgtttcttttgtcatattaaattatctaatgcagtgatgtatacaaatagtttgtgtatgtcgtcacaaaaataaaaggttccttctttaacagctccaaatgaatcctttcttatgacttcattgaatcaggaagactcagactactctcagtgtagttattttgtgatatcataacatctttgtaaacctggtgggaggttgtgatagtgtgaagaactgaggattccagatttctggtgttaacactacaactcaaacgtcctggtggtagaaatgttaatcaaggggagttcacatttccctgttctggtaatagacagtattgccctggatttaaccttttcttgctgatgtagggtcagttggagtgctagtaaactatctgctagctggggcaggcttagaggggttggttggggagggagttaacaatttatagcatttttcaaagtggtaaaaatactccccaccatggatgatttcaacctaccgaatggttgcggcttgcagaattcctgaatatttgtttagtagtggagtggtccacagcacacattgcttggaaaaatcattatcatactatattcttgtggattcagctactgtatacagtaagagacagacataacactgactggacgctaatcctaagtttagagatcctagaactttcttagaaaaatcactgaagtctttggaatctttctcatgaaagtggagcaagaggatataaatttgaaagactcagggcagagaaatgtaactattattctgtaaacctagtgttttagttgaaggctgaatcaaccttctgctaagtgattttcttaaacctgtaaaaataacagcagaatacagggtgagtatccctaatctgaaaatctgaaatctaaagtgcttcaaaattggaaactttttgagcactaatatgatgctcaaaagaaatgctcattggagcatttcggatttcagattttcagaatagggatgctcagccggcaagtataatgcaaatattccaaaagctgaaaaaaacatcagaaatccaaaacatttctggtcccaagcattttggatgagagatagtatgtgtttggttttctcatcagtgtcagttatcttgttagcaacatttagatttttgtctttcagctttctgctacttttgtacaaaccatactgtacaacattagagcaagttataaaaatagaaaatgtatttatttcatgacacttcacatcagttgtcacttttctattaccttttgtgctaacccagctatatcatagccaaagaggacctgtgttgagttacaaaattgttcttaccactttctgtgaagtacttgtcaggagtcaggcaaagtgcttattgaaaaggcaaataagaaggttagtataacaaatactctaagtatatacttggttttcttctcttagtggagtgtttaaaagacatagttaagtaatgataacagtgtatttttgaactgtaacatttataaatacaatatgtatataacatgtataaatacaatatgtatataacaaaaggaggaaaaaggaaaatagagctatataggcataatgttgccacatctcactggaattaagttaatataaacctcactggaattaagttaatataaatctaaagagactctgaagatgtgaggtaagtcctagagctactacaaaggaaataatcaaaaatctctataaatgaaaaaattattaaagaaattaaatattacatttgaaaatattcacttaatgtaaaagaaaacattaaaggagaagtagaggaacaaaaaaagacacaagacatacagaaaacaaaaagttaaattgcaggcacaaattcagctgtgtcaataatatcaataatatgaatggattaaacagtctaatcaaaaggcatagattgtcagaccagattaaagaaacaagatctgactatacactgtctgcactggcactcactttagatccaagacacaaatatattgaaagtgaaaggataggaaaagatgtatcatgcaaataacaagcataagaaagctggagtggctatgttaatatcaaaagggacttcaaaataaaaaatgttactagaggtaaagagggacattttctaatgatgaaagtgtcaatccatcaggaaggtatagcagttataaacatgtatccacctgataatagagccttaaaatacatgaagcaaaaactgataaaaatgaagggagaaatagacaattcaacaataacagttggagacttcattaccccactgttaacaatggatggaatcttctagacagaaggtcagcaaggaaatagaaggcttgactaccaacactgtaagccaagtagacctaaatactccacccaagaacaacagaatacacattattctccagtatacatggaatattcttcaggatagaccatcacctaggccataaaacagttgatcattaaatcaaaaagaattgaaataatatagtttgctccaactgccatggaatgaaattagaactcagtaacagaaaaatgtactgatgtgaaaaaattcttccagtcccacattgtccctaagaggaggagaaatgtcagtcagcaaaccaaacttctgttgtacaaatgacaccaaggctttccagacaagtagactaggaacattgctgtcatactgataacaggtaattctgcatttgaattcctctacatgaggaaactagcaaagataagtgcctctggaaatgttttctttgaaacaaaaatacagcttgatgtacaactacaattcctccaagaaaaacctcaaagtaaaaaacatcttcgtaaatatcaagcaagaagcgcattatttgaagatacagaaataacatttgatctcattttcttaaggtagagtcagagcatgttaagagctgaaacttttagtacagaaatacacttgtgacccagtgttgttatgttgtcagttcttaagtacatacttataaaatgattttgtttttttatgtttgttttattttaatagtgttcagtctactttaaatattttgtattttaataattagaataatagctttttaaagaaagttattttaaaacatcaaataaaatatatgtttatgagtttttttatgagaagggtattaaacatttagtttcactgaagctaaaataccagtgttaatcccggccctgtagtatgatagaaatatacatgctgaaatagtggtgtagccattttgtcctagtattgcaattgcaaccagcgatggtgttgattatgtaataataataataataataataataataatatcaacagaagcaataataatgaactaaaattgaagttctgggcacaatgccaagctgtctacatgcattatctcaaataattctcacaaccccatgaggtgccattatctgtgttttgcagataatgaaggctcaataatagaacttacccaaggtcacatagctgaagcggcagagccagaacctagaccctggcttccctgtcttcagagctcaccagaggacatatgtgaacagtgatgatttgagaaaaagtgagcggaagtggtaactggatgcaagagtccaggatagtttctagtttagacaactgcatgaatggctgtgccacacatggagacttactattttttttttttatctatctggacttaactgtattaggcagctgttattatatttaatattctggaaaatttaatatacgttacttgaaagttttgagtgtttttgagggaaggagaagagtattgtgtaggtcttcaatagtgtattcttattttcttcctcagagacctgttaaagtttttgctttcttgggctaattttatttataatataagttaaattttatgtgttattcaggttgtctaagttaaaatagaatacaatattctcataattttaaagagtttcttttagttttccatttgtgcaagtttgttgtggcaaattctttcaagtgtcatatattagaaaaggtctatttcactttcattgttggaaaatattcttgctgggtttggaagcatagaaaatctagcctggcattttattttcctgagtacattgttggtgtagaggtgtcactctattgcttctttgaaggtaatctggcttttaaaaattactagtaattttaaaaattatttttaagattttgggccttgtctttgactttcatagtttcaaagtgatgtgtacaggtatgatttctctatatttgtcttgcttgtggtttagagtgctcttgaatctgtagattcatgcatttcattcatttttaacaatttttagactttatctccttacatattgcctctgcctcattgtgtatctttccaccttctttgttttgttactttctggatattgtatcctttggtctcctaatactttattctgtgttgttttcatctgacttattctctctctctctctttctctctctctcttcgtttctctctctctctctctccttttctttccttttttttttttttttttttttttctgagacagggtcttgctcagtcatccaggctgatataagctcactatagcctcaaccacctgggctcaagcaatcctcttgcctcagcctcccaggtagctggaactgaaggcatgcaccactgcacccagattatatttgttttttgtttttgtttttgttttagagacaaagtcttgctatattcttcagcctggtcttgaacttctggcctcaagcaatcttcctgcctcaacctcctgagtagctgggagtggcaacctctgtgagccactgcacctagcaactgtctttttcagttgttctaatctaaatttaaatctatcttagttctattatggtatttttttcaattctgtaatttatatttggcttttcaaatatgctgtgtctctttatacttccagttttctgaaattttcagtattcttgtccttaagtaagcacatttattttaaagtctttgtgtattcattccaatatattggacccctgtaaatctgtttataatgttggttctttcatgttgaattcttttctcagatgcctggttatctttgaatatatgatggacattttattttaaaaattatagaaatgttttaagcctaagttgacaatatcttccttcaaagaagatttcagttttcttcgccaggcttctaggagaactgacaatctaagattcatcttaattgagttttagagtgtgagatttttggggccattgaaagtgagttgcagtttatgtgaagcttgatctttatgcaattttcccttattcctagaatgaagccctttaggttctcagctgaaaacatgcaggttttaatgcggactccatgcatggcatgccctggattctgtcatttgtacctttatagctcctttagattgtcagaaccgcccagccttttagctgctcttttgaatagacaaaccctccctaatcaaaaggagccccagctactgatctcccctgtttggacttttatcctctccaggatcttggctcagtaacttttcactatctttttattgcttaattgccttcaagctgatcatgtttatattttgtctaggtaatctgttgtcctgagaggaggatcatctgaattacttaattacttaattcttaattactataagtcccttataaaagttctttatacattatcatattaacctttgccttacatgttgcagatactttctcagtttctcacttgctttttaaaatgaaaattacatacacacacgctctcacacagacacactccttagtttttatgtattcaaattgctttgcttgcttttttgcttagaaagtgtaatcccagcccaaggtgagctaaatatttattcctattttcttattctttttgtggttttctttcttacattgaattattgaacttattttggtacatgctgtttgcttaagatctgtttctactttatcatccagtgtatgagacttgaatctcttttcccaaaaattttgaaatatggcacctttttcatttactaagtacatatatacatatatatatacacatatatacatatatatacacacacatatatacatatatatacacacacacatatatacatatatatacacacacacatatatacatatacatgatagggcctttttatgtatttttggtttatccattgatctgatcttgagaaaatattgtcttaaccatttaatatcttttccatgaagctgtctttacataattttctttcagcattttattgttcaatttagagtgattattttctcaaatggagattggaggcatgttacatttcttaaaagagtaaaattttttattgtttgaaattttataaaacttggatatttgcaaattgacgtactcaaaatattattttttttccgggggatggtgtgtttctttattatgtaagccacttttaaacaaaaactcatactgaaaactttaaaattttctgtatgtttagaattttctgtgcgaaattatttcatggcattttaatatttttattaatattagtcgaagaatattttccattgtattttctaactaatcatttatggcataaggaaaaagactgatatttgtgtgtttctgtactgaactcttctgttaggtataatagattgtcagtgatttcttatgggttctctaggagaccattttattatcaggaaataatgctattttccttcttaccgtcatttatatttcattgatttttattctttcattgtgttagttgaatagtctacagaagtgattaaaaataagtggccattgcaggaatcctcttattatcccagacctcagaaggagatttttctaggatctggctttgagtattgcgtatcattggcatgagagatattctttatcgtattttcttagtttgctagttttattttgatttttctaatttctcttgtgactttctgtttgacccctgggctgttcagaattgtattgataactttctaaatatttggaggtttttcaggtatctttctgctatttctagtttaattttgttgtgttcagggaacatactttctatgtcctcttaacttttttgaactgcatactttgttttaaaatttaagtagccaataggcactgtacctagtgctccttgaatatgcataccctagagatgccatgggtttagttctagaccactgcagtaaagcaaatactgcaataaagcaggttacgtgaattttttttatttcccagtgcatatcaaagttatgtttacattatactgtaatccgtgtaagtgtgcagatgagcattggctttcatagcattatgtctaataaaacaatgagaataccttaatttaaaaaatattgccaaaaatgtgaatgatcatctgagtctttatccagtcataatctttttgctggtagagggtcttgcctcgatgcagattgctgctgactgatcagggtactggtggctaaaggttgggtggctgttgctgtgtccagaattggtgggttcttggtctcactgacttcaagaatgaagctgcggaccctcacggtgagtgttacagttcttaaaggcatgtgtccacagtttgttccttctgatgttcggatgtgttcggagtttctgccttctggtgggttcgtggtctcgctggctcaggagtgaagctgcagaccttcgtggtgagtgttacagctcataaaggcagtgtggacccaagagtgagcagcagcaggatttgttgcaaagagtgaaagaacaaagcttccacagcgtagaaggggacccgagcgggttgccactgctggctcgggcagcctgcttttattctcttatctggccccacccacatcctgctgattggtagagctgaggggtgtgttttgacagggcgctgattggtgcgtttacaatcgctgagctagacacaaaggttctccacgtccccaccagattagctagatacagagtgtggacacaaaggttctcgaaggccccaccagagtagctagatacagagtgtcaattggtgcattcacaaaccctgagctagacacagggtgctgattggtgtgtttacaaaccttgggctagataaagagtgcctattggtatatttacaatccctgagctagacataaagtttctccaaggccccaccagagtagctagatacagagtgtcaattggtgcattcacaaaccctgagctagacacagggtgctgattggtgtgtttacaaaccttgagctagatacagagtgccgattggtgtatttacaatccctgagctagacataaagattctccgcgtccccaccagactcaggagcccagctggcttcacccagtagatcctgcaccaggactgcaggtggagctgcctgccagtcccgtgcactgcgcccgcactcttcagcccttgggtggtcaatgggactgggcgccatggagcagggggcggcgctcatcggggaggcttgggctgcgcaggagcccacggagggggtgggaggctcaggcatggcgggctgcaggtcccgagccctgccccgcaggaaggcagctaatgcccggcgagaaatcgagcgcagcgctggtgggctggcactgctgggggacccagtacaccctctgcagccgctggcctgggtgctaagcccctcattgcccggggccagcagggccggccggctgctccgagtgcggggcccgccaagcccacgcccacccggagctccagctggcctgcaagcgccgcgcgcacccccggttcccgctcgcgcctctccctccacacctccctgcaagctgagggagccggctctggccttggccagcccagaaaggggctcccacagtgcagcggtgggctgaagggctcctcaggtgccgccaaagtgggagcccaggcagaggaggcgccgagagggagcgagggctctcaggactgccagcatgctgtcacctctcattgccatttctttttattttttatttttatttttacttttttttgagacagactctcgctctgtcgcccaggctggagtgcagcggcgcgatcttggcttactgcaagctccgcctcccaggttcacgccattctcctgcctcagcctcccgagtacctgggactacaggcgcctgccaccacgcccggctaattttttaaatttttttaaattttttgttagtagagacgggatttcaccatgttagccaggatggtctcaatctcctgacctcgtgttccgcccgcctcagcctcccaaagtgctgggattacaggcgtgagccacagggcccggccgccatttcttaaagcagtgaagtttgccaccttgacttttactttcatgaaagatttctctgtagcataggatggtgtttgatagcatttcacccagagtaaaacttctttcaaaattggagtcagtcctctcaaagtctgccactgctttatcaattgtgtttatgtagtactctaaatcctttgttgtcatttcagcagcgtttacagcatcttcaccagaaatagatttcatctcaagaaaccactttctttgctcgtccatagaagcatctccttatccattcaagccttatcgtgagattgcagcaattcagtcacatcttcaagctccactttagttctgcttctcttgctgtttccaccacatctgcggggacttcctccactgaagtcttgaatccctcaaagtcatccttgaggactggaatctgcttcttccaaactcctgttaatgttgccattttgacctcctctcatcaatcatgaatgcttttaatggcatttagaatagtgaatcctttcaagaaggctttcaatttgctttgcccagctccatcagaggaatcactgtctatgacagctatcaccttatgaaatgaatttcttaaatagtaagccttgaaagtaaaaattactccttgatccgtgggctgaaaaatggacattgtattaccaggcatgaaaacaacattcatcttcttatacatctccatcagagctcttgaatgacaaggtttattcaatgagcagtgatattttaaaagaaatctattttttctgagtagtcactctcaatattgggcttaaaatattcagtaaaccatgctataaacagatgtgctgtcatccaggctttgttgttccatctgtacagcacaggcagagtagatttagcatgattcttaagggtcttatggattttcagaatagtagatgagcgtttgcttcaacttaaagccaccagctgtattagcccttagcaagagagtcagcctgtcctttgaagctttgaagccaggcattgacttctctctagtatgaaagccctggatggcatcttcttccaatagaaggctggtttatctacatagaaaatctgttgttttctgtagccaccttcctcagttatcttagcaaaatcttctggataacttgctgcagcttctacattaacacctgctgcttcaccttgcccttttatgtcatggagatggcctctttccttaaatctcttgagccaacctctgctagctgtcagcctttcttctgcagcttcctcacttgtttcagccttcatagcattgaagagagttagggcctttctctgggttaggctttggcttaagggatgttgtggctggtttcatcttctgtccaaaccactaaaattttcttcatatcagcaataagactgttgtgcttttttgtcgttcaggtgtttcctggagtagcacttttaatttccttcaataactttgcctttgcattcacaacttggcttactggctggtacaagcatcctagccttcagcctatctcagctttcaacacgccttcttcagtaagcttaatcatttctagcttttggcttaaagctagagacatgcaactcttcctttcacttgaacacttagaggcccttgtaggcttattaactggcataattttaacattgttgtgtcttgggtaataggcaggtccaaggagaggcagagagacgggaatggccagttgatggagcagtgagaacacacacacaacatttattaagtttactgtgttacatgggcacaattaatgcagccccaaaataattacaacagtaaaaacaaagatcactgatcaaagatcaccatgacagatataataataatgcaaaagtttgaagtattgcaagaattagaaaaaatatgtcacacaccagaagtgagtgcatatgtttggagaaatggtgccaagacagacttgctccatgcagagttgccacaaacccttaatgcaaaaagcacagtatctgcgaagctcaacaaagcaaggtatacctgtattcattttcttttgctgcgtaacaaattcctacaaacttagcagttgacacagtacttactgtcttgtggttctgtaggtcagaagcctgacacaggacctggctataatgatgatgtcagcaggtctgtcttctggaggctccaggggaaattctgttttcctgcttattcaggttactggcagaatttagtcctgtagctgtagtcatcatgttcttgtgagctgtcagctgaagtccattcccagcttttagaggctaccatgttctttggacgggagctctctttctccgtcttgaaagccagcaatggcaggtcaggtctcatttcctgtctctctcctgcctcttcagttgttcaatacctctgacttcagccctaagagattctccattgttatgggattgtgtaattaaatttgaaagagtcctgcagtaaccgaggataatctccccatctcaaaatacgtaaccatatcacatttgcagcgtcccctttgccacattcagaaacatttacaggttccagaggttggggtgtggccattttatagggccattatttcacccaccatgctgccatattggacagtacaactttacactgtattatcttttaaacggtgaaattttgaagtgataaaattcttaaagttctttttataattttattattgtcattttcagagctcttcatttatatgtatagatccacatttaagttttaacatttcagtataggcctgaagacaacgaattctctcagcttttgtttttctgaaaaaaatcttgctatggccttcatttttgaaagctaaattatttctcaatatgaaattctgggttggacaatttttttttctttcagtagtgtaaaaatatcacaccatggtttccgttgagaagtctgctttaatttttatcttttattctctgtgtgtaatgtttttctaccctctggctgctttcaggattttctctttatctttggttttcagcagtttgaatatattgtctaaattctttttctcccttttcttctttttctcagtattttttttattctttatgcttattctttcgtatcatattcttaatcatcctagttatgggttatttaggctttttggatgtatggtttgttgttttcattatttggggaaaattcttggccattatttttttcatgtatttctactaccctgtttattcttccttttcctgccggttccttgtgcttatggcggggactgggactctgggggcttttctcagtgctagtgcccctgctcagcttgcagcctcctgcgccataggctgggggagtccctgcccacctcctcaccgcccccctagcagtgggctgctgctgcttcccccacagggctgggcttctggatggggtggggaggggagggttgctccatctcctggtccagcctcagtcttggcggtccctgtgtttccagcccctcccccatggcaagggactgaaattttattggtgtgggattttggtctcaggacagtttcctgcctcccctggggtagagggtgtcctcctctgttcttctcccggctgcagggtgtttctgtctgtccctgtggtgacatctgctgccctttccctatcagcttaaagcccaaggctttgctcagggggaggaagctctcagggagagttggcttcatgcctgtccactctgcttacacgcttggggcacttctctggcctcgtcctgcccctcatgtgagcacctggtgcgggcccatgttaaagagcctgtaagtgagtgtggactccctcagcccatcctaattcaaaggcagaagatacacatgtaaacaggcaaacagggcattctagattatgactgtaaagaagggtggggtgggcaggacagggacaccgaccttaggtagagtggaggaacagcccagaggtaacactggtgcggtgagttgaaggttgaaaatgaccctgtcatcttgagagttgggtgtagggagggcttttcatgctgaggagatggcaagtacaaatcccaggggcagcaacgagatggggcagttcgaggaggagaaagtttaccgcaggctgaagcggagtgagtcaggggaaatggtgtagagggaggttggagagttgtgagtcagatgtccctgcagtcttttggccatgttaagatgcttgaattacattgcatgaggaatgggaagaacttggtgatgatctgaatgtagcttccttttgcttgctaagtgaattccagtctcttctgctttgtgttcaaggcctagagtaacctggttgtagaataccttttccatcctatctcccactctactaatagatgaacagcaaggttggcttcctgctcttaggtgagtcttatgcattttcctgctcaccttgtcatgctgttccctaactggaaaggacttgtccctctctgcctgtctctgtaggctttagtcagatgtgctgctgccacgaaacttctcccaggcatttccttacctccatcttcaccagttgttcccacatctatgtggtagcttcttgagtatacctgtttatcacacattatttgtttaatttgtttaattaatttttaaatttgttttatttaattaatttttctgtcttgtatctttattctggttctctctgccaactttcactacctgtttataaacacactcaaccctcccatatcctaaagaagacttcccttgccctcctttcccctgactctgacgtcttgtctttctcttttactttacagccatatccccaggagagcgcctgtatttgcgggccctgcgcgtcctcatgccctccttcactccttactggtatatgatagggtttttacctccagaaccccgctgacactgctttcagagataatgatgtcttcctagtcccagtgaccaccaagcccagggacctcttgttaattttcatctgtgtatctgaatgtgatattcaacactattggccacatcttcctttttaaaagtttctaaacccccacttcctggctgttccactatcacatgttttgtctcatctttctgatttccccttgtttctttttgtttctagctcacccctaagtgtagggattacccatccttctcatgtcagacctcccctctccacagcatattctctttggcttatcatttatgtccttttacaaaaacagctctcaccgcatattcccagatctgtgcctctagcccagacctctctctagagggaaaaaaaaagaatgtgcacgtacacttaatgtatcataattttcatattgctgtgtaatctttgtaattattttaaatggatgtataatgttatgttaagtggctgtgccataattagcctaaccatttcctattgaaaatttcttgtcctgaatttccagctacagtttacaattctgtgcatgtatattgagtttgagattgatgcctgagttcagggtagcattttaactcttgcacaaactactgaaaaaagccttctgaatggcctcctggtctgatctcttgaccttctggccgagcatgatctcaattgttagaaaacaggtactacttatgttcctaaggcccaaaagagatctgaagtttttcagctgacatgtctctgagtaaatctgaaaagagatttatttggaggttcaccttcaatcaagacaggattttaagcacactctgagctgtggtttatcatccctactacttaccataagaatatgctttaccacactttattggcaactaagatgcactcttgagccttttaatctgtttgcttttaatctgttactctctagaagtaatcctgaaaaacagctgacagtgatatttcaaactcgttggtgctcttcttcaaagaaacatagaagccctaataaatagatttgtgccttggaaaataaagtgtcagtgacttcacatagaacacaggaatcttaacttatacttccccaactattctttttttttttttttttttttttttttaacaaagtggcccctgtggtctttctaagctgttcttgactccctaactgatgaagagtgctggctttcctttcgaagcccaggtcagtggtctgacaggggcagtgctgctgattttggtccctctcctgagtgtgctttgtatctgttatatgaagtcgtgtttggatttttgatgtgttgatacctcagagtttctgcttgattttcagtcattaccggtagcacactgacaagtgggagaatacagttttcagtggctgcctgactcctattttgaatctttctcttcccttcccaatctgactgtaagttctccctgtgtaaggagagagggttgtgtttcaatgctggtgtacaccaagtatgtctaaacttagtaatggtaaaaacaaacatgcaaaatgacaacatttctggaatcagggtggtgaatagaagccagtgtacttcctctgaggcagaggctcgcggggggtgctggttggtggggttggtggggagtgatcacattgcataagctccatgtgaatccttgggctgccttctactgcttggtctttctctttgtgtcctctaatgtattttatatttaattcaccttaacaacaaattgcctttaaaatgatggaaaagcacaagtgctaatggtgaacagctgtctcctccttctcttcataccaattttatttctgctttgaagcactatggtctatgcatcctcttgactatgttgtagatatagccacaaggtttgatgattgtgctcttttctatagataagaggacaagagaaaataactccagtcactctttaatagatagatttaaaattaatcaagatgagggtaagtttaaaaaactattccaggtatttcattatctgaaaacccaagggtctgctgccttccactctagggccttggttctcgagagaaggtatttgtctataattcctagcctgatggtttagctgcccactctgagctgttcagccccagatcttgagaatcaaggggtggagagtgaaaaatgtatggagaggcaggcaccttgctttcacttccacctctaaaatgatagtgcagtattcttctcacatatgcctgccatcgtccttctgtttgcatctctcacatcccctccactagcctctcccctccttacaataaaaaaaaaagtccttgaatttagactgatccaaggtccagggtcatctcactacctcctcccctcccaagcaccagtggtagagtgggctttatcccttgaacaaggacagtgaacctgttaaagaaagaagatccaacaaaatccagaagaatgaacacaactcaaaaaagactgtcaggagtatgttctcagctgagtgctgagtgagatcaccattccccatgatctcaggcagtagaagagccttgagaatgtggaagacaggcccaaattctgccttaaaggaaatattactccagaaacacaagtgtttttaagtgcagaactaaagatcataaatgtatttaagcaagagttcaaacttaatatgagacaataaaatgagatgaaatgggaaatatggaactaagggaataaaatgagaacaaaatactatcagtccaaaactaatgaataaatatgaaacagtaaagaatttaatggtgtgacaattcagttgtcaacataagagaaaagctttagaaaattgtagagaaaacaaaaggtaaaaaccttttccctaaataaaagaactttattccaaaaaaagttgaccagaaaacgtatatgaagatatcatagaagaaaagttttctgaggtgtaaaccaaattgccagaaaacaagggagtatgcaaagttttgaagggaatagcaccagtcaagtgttaaaattaaatagataactaagtataaacaacgatacagataaaatgtaagtgttataagctttgacaaatgagagaggaggtcatctatatgtaaaatcaaaacgtgtagttcaaaagttccatttaacatatgtgtttttccaattcttaactcccagtagatttatagaaaatagtttctcttataaagaaatatggatcttaagtttagcaattcctttatcttaacttcaatgtcattttcttttaagtacaaggttacagtttttgttgttgttgtttaaatcacatacagtatttctgggttgaaattttgcatttttctttggagtataagacattatttaattttgaataacataactttatctaaaaataaaagtttatcttaaaatgtttgtgaagcagagcaaaacaggcatacctaccctgtccaagactctggttgaataggtcctggatggggcctgacatgggtagattatttttaagtccatggtgtttcagctctgctagcttctcatccaagtggtttctcatctctgtttttgtatttattttaatagcctcctggctttcacctttatgatacccacatctagcttttggaagtggatagagagactactcagcccaggttgatgagcatcatttttcactttgcctacttgcctgatagagttaatgagagtcaaaaagtgcatcactgactttcttacattcatcttaataagggaaaaccagtgggaaaacatcatttcatgagtgagtggattggagaataaaaaaatgtttgttcaacattttgtaaaagtgaataatactgatacttttttctattgttctttagctcaaatattttagttatgagacccccttttgtttttttttttattatggtgggtaaatatatctttaatggaatagtatgcatttttttcattaaactatgatatgagagcatataaactgatgtcacaatattactagaatatttctaatgtaaattttattctcaataagtagttattacagtgtagacattttggtctaatatgaatttcaaatatgtacgttgcaacagctatttgaaaatagtggagaattaagtagttggctttctacaaatagagtaatatacgattgaatattttttgttcatatgcccaacaatccaacaaatggaaaccaaagtaaatcatggcaagtaattattgctcaaaaatacagtagttgatagattgtgggcactgtcacttaaatactgatttatttccaacacaactagaaattaaggtgatttcatttctcttgcaataagttttaccttctttctgcctatctccctacctgcctacctgccctacctattgctaatgacaaagaaacatagccattgaatattttgttgagttaaagtggtgattttttttaaaccaaggcccattacaaccttatgactttttaattttgttggtaagaaaccacaaataagtggattattttagtttcataattttctgttcattgatataattgctacatcagcaatacttcatggctgtcctgactatggtctgctctagaaattatattagcagccccttttctcctgaaaatatcagttttgcatacttagaaatttgctgaaaagtttgttttaaaagaaccttaatgagataagacagtcaaatactcagcattaaagggttgaattttcttctttttggccagccttctcagactgttgtgtagacagagtcctcaggtattgctaccaagccaatctaggtccatttgtctgcacacaatgaaaagccaaacactgaatcactggatttttatagagagaaagattaatggcaaggcagccatgcaggagatgggctcaattctgtcttcccttaccagcttaaagcagtatataaaaggaggagatgctggaggaggagttttggggttggttaatgattgttggaaagggaggggaggtttggaaagtcccttgagcaggcacagttgtctcttcgtgcttcctcatgggttgcctttgcaaattcggagggagttggtgtgaaacctgtggtgaaaatactggctttgatatcagaaagtccctcatctggcaagaagtctattctgtgcagatcccaatcagccataccagttccaaccagcttcaaccagtcaaccagttttgttacaagcagagggagttctaacaagctgtttctttatctgcagtgctgtaagacaagctcaaaacttcttgttagttaccagtttctttaaccccatggagcactgtttaagtatgatagtgaaaaggggaaagataattcagttttgaaagatctagttccaggatgttgattattcaagaaaggaacataagcattctagaaatgcacacttaggtctttgaatgagtgtttcaatagattttgattggcatcattgttcaatttccggaatgcagaagtgcaattttatttaaaaaatagactttccttaaatactttcttcacttgtcataatgtccttatgatagtaatcttaattttcaaaaaattatagttggtgtatgtacaatgttaccaattgtttgttgttgttgttgttttttccagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagcctgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcactttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcagcctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacataatgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaagtccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttgtccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttaaacatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaaggtacttgaaatataatttatcttcagatatggtttgcgcaaatttgtttccatgtgtcttgatacctttaaatattttaactggaaatattttaattttgagtgacaaattgtgctgtaaatgtcttatttgaaagacagggtgatatatttaccccaggagttacattgataagagttaccaagagtcttgcagtgattctatcttgaaagattttagaaatgatttaccctgagcacttttctttttctcagctaactatataagtctttacttagtagtacagatgatcatggttttactttgatgttttacttatattgaggttttgtttttcttgttaagtgaaaggaaatcatggttatgctttgttcctcctcatgcagggaaacaggtgtagataatcaaagatagttgtatttcatcctgaaatataagcagaaagccatttagacttgtcttgagcttactagctacacgcccctgtcatgctatgtagctgtcttccagtgtagctgtgagaaccattagcactagagagaagtttcacaaaataattcatatacttggtaagttgatttggtcaagatttataaagtaatttaaggtcatgaaactgtaacttggggtaatttgtggaatcagtctcattagaattatcagctttataaaatgggaaaaagtcatttacttgattagaataataggtaagcatatcacgttcgactctgcatattcagaagtatttggcctctgcagattcataagcatgcaacacaggttaataaacatttacaaatctgtcagtaggaaaatactgcagtatcagtattaccatagaattatgaacaattctaaagaaggaagtttctaacattactggtaggtggaagagagaagaattcagcaaacatactccaaaggtggtgatactttagctaactgttcaaattttttttaaaaaaatagggatttttcaggcaaagaagaagcagctttttttttcgagacagaatctcactctgtcacccaggctggagtgcaatggtgcgctcttggctcattgcatcctcccctcccgggttcaagcaaccctcctgtctcagcctcctgagtagctgggattacaggtgcccaccaccacgcctggctttttgtatttttggtagagacagagtttcgccatgtctggtttggccaagctggtcttgaactcctgacctcagatgattcacccatcttggcctcccaaagtgctgggattacaggtgtgagccaccgcgcccagcaagaataaaaaaaaaaattaataatacacgaaatgacatggaaatgagaataaacttggttcatttaaagaactctgaagagtctggcctggttaaaaagagttataatttggaaacataggtaaaaatcaaatcatgtgtatggtggtggagaaccaatgatactttctcagtgaaggaaagtgcatccaaaccacctgtggaatttgttaagttctcaggctctaaatctactaaatcttggaagttaagacctaatagttagaatttaaacaaaactccgtgtatgttcctgaagtgtttgtggagaagagaagtggctctccttgagtaccaaatgccttggaagaaatgtctggaaatgcatatctagatttggagcttaggagagagctctggatggaagtgtgtagagtagagattcttttgtgtagagtagagattctttagtgcataggtgtgattaatgagattgctcagggtataaagaagaggagagagcctagactggatactggggatcactactatttaaaaagttgaatggttgaagaaagtccacactcctgtatggaaactgaaagagtttgatcatagaggaaggataagaatgagcagaaagtggcatcacacaaaacacagaagaagatattcaaggagagttgttaggtcaaataaagttgaaggcaaatgggtatatctggactgcgcagatcactggagagttgagtctatgagcaagtggctatggagcatggattactgggcttttatccacaactcaaatgttaatgcatttatgattcacaatgggaaagaacagatagatgctataaagtaaaaggatttctaggcaaaacatggcattttcaacatacaatacatagagtgctcaagcatgtaaagactaagattttggcatttagctcattgataactttggcaagtagaagccagatttaatagtacgaaagtgagcaaaagataaaggggaatttgatattgaaaataaagaggattactgttaaagggataaagtcaaaggaaggtgtgtgcatatattctaaattatgcggaagccaatctgtttgccaggaaaagagaaggaaaggttgcatcagtagctcttccctctgcctttttgaggaacatgggccagcagcttttctttcctcctgcctgtgtaaggatgggcctcccaaggtactattctgaggccacacatacccctctccataatgaacagactcttatctcttagtattattaagtcatttcagcaccacagctgtctgcttgacaatgtaatttcttaaaggaggtttgtataaaagaagcccttggtaggaaaagttgtgcgttgcgttggattcagccagaggattagagtttgagcctttacttaacacttgacctgggacaaggaacttcaccctgagagcgtccttcctcactgggatatatagtccacctgtgctgcctgcctcacagggacctgagagaatggaatggcactataagtgagacaacatactatcaaatgggtagtagcataaaatcttacataaaatcataaggtggtattatattattatattgttcctataggaaaaccacacatcgtttatcattttgattttgacgttcgttaccttttttccagagacttaattgttaccaagccaaaacctaactttttggctagacctggatgccacatttatcagtattcagtaaacttttgagaagatagaaagaattatggttttagctgggcatggtggctcatgcctgtaatcccagcactttgggtggctgaggtgggaggatcacttgaggtcaggagtataagactggtcggtgcaacagagcaagacccccatttctataaaattttaaaggtagccaggtgtggtggctcaggcctgtggtcctagctactcaggaggctgaggtgggaggacctcttgagcccaggagtttgaggctgcagtgagctatgattgtactactgcactccagcctgggcaatagtaagaccccatgtcaaaaaagatttatgatttaaaataatggaggaagaaaaagtaaaatattgggaaatggggcttctgctttaccttataatgcactgaagctgaaggagacttaatgatgtttctaatgggtatgaggcattattttaccaaaaggagtagctagctcttttccatctccaaaagtaaactctttaagaaatgtacttaaatggtagtatgagtggctggttaaatggaagaaaaaatatttagtctactaaaaaaagtttctgttaaacttaagaaataccatggtataggaggttgtaaagcctttatttgggggtgtcagtgaactgtggtggaattttaaattaacataagatttatcagtttgctgtgattgagacagattcataagggaggagataaagtaaatgccctttgaacctattactactttgaaatgcatttcgttgaccatatgctctgtactctgccatgttttaatttccagtgaaagattagcatgcttgtgttttcagttttattaaattagtttctctcttttttcctttcagagagcattaggtaatcaaaagtccacagtagttgaattcagcaataaagatgcctctgaaattaacagtgagcaagataaagaaaattccttaatcaaaagtgaaccaagaagaattaaaatatttgatggagggcaagtacaaattttacttcttaaatgtacatttaaactgactttttaaatgtacatttgctttcatgtgaatgaagacttagtgccaatttagtatcgatgttgcaaggtttctcagcatattaacagaatctccatagcaaaatatgttaacattatgttaaatcattttattttgatggagaaatgatgactatttgggaaatactgtacaaccttgaaggcagctaaaaactaaattattagagtgaaccttggttttcacattgatttacagtaaggaatgacctagagaatctgctctcagatgaattcattgcccattagatatctttgtgtattttgttgtgaacaaaaacatcataaaagccaattatagttatagtaaagctccaaaatatttcagtacttaaaattattgtggttgaatttagcaaagaagaacaaattttaaccaatgacttggaaacagggaagtattttaaaattacatgcagtagtgcagcgcagtggtgcgcgcctgtagtcccagctgttcgggaggctgaggcgggaggatcatgtgagcccgggaggttgaggcttcattgagctacaatcacaccactgggctccagcctgggcaatggagcaagactgtctctaaaaaaaaaacaaaacaaaatataatattgcaaaagtttgtttgattagaattagctatattaagtgttgatgtaaaaagctggaatattctgttacacatgcataaaattgttattggttgagtataaaagttgtgccttgttttatctttgggttgaattttaatcatcaatattttctcagaggcatagtgtccaatctccctattcattttttttctttaaattagatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggtatgagatgcacattgcttcaaggtccttttaatatgtatttaggtgggaaagctaaaacccaactgtgcgttttctttgaccgatgaaatagcagcttaaatagactaatgtcaattacatcttgtcaatgttgtagtcttattactttatatgattttagacccattgggaaaagtttttaattgtacacttttagaataaatatataataaatataatatttttaaaagagcaactgccctttttaaaaaacttaactccttaaattgcagttgtacaacatgatgactaatataccttttcaagaatatttaatttggggctgaagaataaaaagaaattttcatgatcacaagtaaattcgctgggtgctaaaagattgaagaaagatttaaaataataactacagtaaacttctataataattacacttctgttttattgtctgattttaggaatacatagccattttttttcacaatgcttttttttacataaatactgttaaattttagcttcaaaaattttctatagtttctattaatgtttataaagaagtctcagaactaatcattaaaattatatttaggaccctttctggttttttaaatatgtttttatttataagcctcactcatagttaattttgccctgtacaagtttcttgatacatataataggtatactactttaaatgtttgcttcctccgtcaggctccttattcatgaacaatttattacttgagattttaattttatatgccactctctaaaaaccaaagatctctctttaacaaagcaaggtaatcgtgaaaacatgtctgagaaaacagtaaaaaaaaaaaaaaaaaaaaaaaaaattaattgatttttaaaaatagaaacaacttttatcctttgagttaacatttacttttttcttatgctggttgtctttgcagtttttgttttaaagattgatcaacttcttagcaaaatttattacattttttggctagtatttatgggcatttaaagagagttataacttgtaacaactacatgcttcaaattagtactctttaagtgccagtggtgtctgaaacaagaatgatggaaaaacaaaatattcttcatatggctttgaatatttcaaaaaagtttcaagaaatgagagaggttgggagggatactcaggatgcagttttttaattgtgatgtagaacctccctctgtcattggagggtgagtttaaggatgattttccttcctggtcctgagggaggactctgatagggtaaagtactttggtcttttaactgaatttattgctttttcactcattttgatcctatgattaagaaacatctattagcttcctttatgagacaagaagcatatttagaaagctaatattactaataaaagattatcatgtacaaaaggatgttatcaaatacaagaagatcaagatacaatgggaaatgggtatttctcaatagaaagaagaaaaagaatgaggctatttaaaaaatatttatcaagtaagggcaaaaaaggaaggacaacctagatgtggtaaaccaaatgaaactacagagatttcttggcaaggaaaaatatgatgagtcacaaatattaatcttagtgaaattaactcgaagattttagataaatgttaactaaatggtggacagtccataatgacccctgaagagtgagcattgcctgttagcacttttcatgtcttacacatctctaatatgctgtatatctgaatttgcattaaatttgttgttttgtaagatgtcatgtggaattatatggtaaatatttatttgaaggaggctatccttgctaaggagactggtgaagaaaatgttagaaattcaggatttcccttttcttggcatgacacttctcttttttttacggtcagcttcctttttgaagtctactttttgtgaatctatgtaaaacagattccacagcaccttttaaaggtagttaaataatagtagacctttttttgaattatgccccagattttcaccttctctgatttacttgctatactagccagtaggactccacttattattgaaagtgtcgggttactaacagaaggaaatagtgatgtgatggcatgctgtataaatatggtatgcaaagacagcaaaacgctctcagaaaaatgatctgtagagctaaaaattgatgcttctgatggtaatgcttacaaatccataattcattatttgccctctgagtttattttgtgagtacattttcaaaataattttaattgatttgttttcatgattctacgttaaaggtcagtcagcagaaaacatatagagagcttgtatctctgcaagatttagtctcatttatatcacagaaaattagactgcatgtagctctaggagtcaagaaacaaaacctctcatgctttccagaggattcagataaatgtttattaaatctatcagaaaaattatttattaaattaacaccaggtttataaaattgctaggagatatttgcatttcaatatgggcacactttcaatattttgtatattgaaatgcagatttttgtttattttacattaggaagttgattcataataagtaatagctaaagttatgagaaaatatgcttactaaaaacttatatttctgaatttgtctagttacaattatacattagtttcttaaaaagtaaataacctgcaatggctgtctatctagggagcaaaaacattttaaaagagggccaggtgcggtggctcacacctgtaatcctagcactttgggaggccaaggcaggcagattgcctgaggtcaggagattgagcctgggcaacatggtgaaaccccgtcttaactaaaatacaaaaaattagcctggcgcagtggcaggcgcctgtaatcccagctacctgggaggctgaggcaaaagaatggcttgaacccgggagatggaggttgcagtgagctgagatctcgccactgcactccagcctgggcaacagtaagactccgtctcaaccaaaaaaaaaaaaaagaggactatagtggaccttataatttggtttgtaatattgttagtattaacacactgaaaacattttgacttacaagtggaaatttcaaccacagtaagatatctaaaccatttttataatttcttaatgtgaaaactttaaagctgtcacataaaagtagagatctgtataatgaacaccattgtgtgcataatcttttaataattgctaagattttgccatatttgcttcatatttttttcagtatatttaatgtaaatatcagagatagccaagtgttaatccaggtgttatctccagaatcacagaagtcagggtttgatggaccttagccatcatctggtctcggcatcctcttaagcctgacctccttaagtactaagctctggggtcctgcgtggttggctgagacaagaatgtactatgtagtgcaagaatcagcttgtacagggatgaccagtttcacaggcttagtgcatttatcaggaaattgaatagatatagctattttccatgtgcttcggctactgcaagcccgaaatttggaccaatgattcagacattttgagctcttctaaagacttattctcaaatactactttgcctctgcccactaaattcaacatttagagttgtttttgtttctcaaaaaagatgacttgcccttgttggcaatgcttttgtgtatggcattatccactggagatgcttgttatcctcagaagaatatgagctgtttcccctggattcagtgatcacttgaggcaggtgtgctagtggttctcagctagcatggtcatacttaaagaggtcgatacaacagctgccagaggaaacactcctttactggtactattttgagacttatactctgtatgtgaaatgaaattaatacaggaaatgctttctcttattccagaaatactgtttataaaattacaatgacccaaaatagtttttcatagtcaagcttgaaactttaaaaggtgaattccaaggtaccagaaaaaagaagctcaaagctaacatggtgaacagatactaacaaaaaaattaaaaggccttatgggaatcgaggccagatatatgcctacaggcttacctgtcctgagatagcatctgaggttcctgaaataagcctagtcctcctgtccagtgactttgggccatgtgggaaaaaccctaaccgcttaaaagtaaaaccctatatctataccatgcaaaaacaaacaaaaaaactggcccagagtcagttgtctgaagccaatgaaactgttaaggtcccaggcagaagcaattggaaaactgctttatagagatgtttctgcaacccagggtacttaggattccatggaaaacaatcttgctgaggataaacttacaattaaaagtaaaaagcatgcaaagaaacaaatgagaaagagccagcagtcataacaagtggagaattcacactccaagaactacagatcatagtgtagtctgaacgggactttaaattaagtatgtataaaatgtcccaagaaataaataaggattagagaatagaaaacataaggtaaaggagatgttatcaaagtagaggaggcagattttaaaaagaaaatataaactgataaataacaaggtattagaacatatagataccaaattttcttttgttcacattttagtcattggagttgtacgaccacaatctgtacttttgcttgaataggaatgaaatttgccagtgtttacaaatgcaatagcaaaatcatactacttaagcttagtaaacattcttttcccttaaggaaatctgacaaaacacatgaagtccaaggcacatagcaagaaatgtgtggatttaggcgtctcagtaggtttaatagatgaacaggatacagaagaatcaggtaaggctttataccatatttttcataaatgctatttataatgtacaatttttttgcttccataccctttccattcccactgattctgcctaattctgttttcattacctcttatttatatgcagtagactcctaattagtttttccatgtctagattgtcctccttcctccttcctattcatctatcccccacgatgttcatctttctgaagcatgtgtctgatcatacctctcctctgctcagaggttctcatcggttcccatctgtctagaaaataaaatgtgaacacttgaccttgatcaaaatcctttgtaatctgctgattacctacttctctacccttctcatttctctcttttacctaccctcatgcttgaatttcctgcctacttaacattgatcgctcttcacctttacacccctcacttaaaaccccagccctcactccccacacaaacgtggctcccagtgccctggtcaaaatctcactttccttcaagatccagccaagtccactgctgtcatgaagccttctctgattttccttttccacacctcttgcaggaaacaattcttcccttctctggactcctctagtattttacaatttcctccctgaaagcatttaatccccctcttgttctgagattattcacgcactcacctgagctcccaccacagtgattcagcatgtcatgagcagagccagtgagtgcttaacgtgtgctcaccagaagcacttagcgcagtgccttgcactgctcagcagctccatatttgtggaataaagcgtttgtttacttctccaaagtgtttattattccgaaaaggttaaatggctgtttttttttaaaaggtgttaacaaatttaagtatttatctctgaccaattttgaggaagaataaacctgttcatgtgttctaactcatcagagaatagaaatatgtttttgtgaaacttgtttttaacccaaggatttattgacaaaagaaaaaaaaaattgaaaaagtattctgctttttaaaatgccctgaattaaacatttacgtgcttgctatatttttcttaacatgtatgagtttggtctagagaaaatttccaaagagaaagtgatgaggacatcattgaatatataggtaaaaattcaaaggcatttaatccctgtaacacacgaaatgaatcagcctgaatttacttataaatatacaagagaaatgactcacgtcttcagtgatacagagcaattcagttgtaaaaagctaggaaaagtggaaaagtgtgtaagagtttcagcaagtacgttcattacccactgactagaaaagggacaaggtaaagctattattatagtatatactcatgtatatcttcttcaagaagatgagtcttataaaaattaatatgtctgtagaattctctaaattgttaagggaaggtagtacttatatcttaaatttgcataggagaattatagtttctgttaattatcatggattgtttacatttgctgactgattgacctacctatgtatttattcattgttgtattttcatctaattccaaaagcatttgaacctggtcttagattattactcaaagttgatatcctaattccctatttagattagaacttctgataaacagcgtagttttacctttttcctttcagtttacttttttttaaaactactgtatttgtgggtagtgtgctcaaagtttttttttttacagtgtttgtcaaataatagtgaagtagaacacagaggtggagttttgccaagtgctgtgtcatgctgtgctagagacctaacattctgtgttgctacaccagcagaatttattcctctccttttgctttattataggcttgcagtgtaagtttaaatatagtaaacagttgttgttttaaacaaatgatcttgttttattgtgcttttctgtgcttttaaaacatatttggagatttttttacatacaaaaaagtacaaagtattttgttgtgtgtactcatgtattaacagcagagttgattataaatattttctcatatttgcttcacgttcttttcacaaattcaatatattttttaaaaaccagctcagcaaggttattgctgctgaggggcagcttccgttactccccactccttgccactctcctgtccctctcagaggagctctcactgcactgggggttttcctttcagttcattcaacgtacatgtatatatctatgaatagtatgtgattttatgtttgtattttaaatttgcataaacagtaccactttgtatgtagatacctagatatttgctttataattttacattgttctccagaagagactttccatttcctcacctctttaattatacctaatattgttagaatttaaatttttggccaatttgatggatttgtttgttgtctttctggtttattgattactaagattgggtctcattattctttaaaacaaacttttactccattaaactgatgatagctggagatgggattttgcttagcaattctgcacatgtccctgtttgaggggacaagtcagaagcctgcagcatgatgctgtgtctggagggtgcactgtttctagccttccactagcccagagtggtaccagctgttccttttcagtcttctgtgctggctcctcctcacctccccagcctctcacataggccccagggctgtggcctttgatctcttctcttcctgtctgtgctcactttgtaggtagtctcatccggtctcctgacttcagataccatttctgtgctgatgatgccccagttcattccacatgtgggtatcattctgacttaccccaccagtctctgctggggtgtctaattagcatctcaggtctgatgtgtcccagatccctggttcaccccttacctctaagcacacttcccccatagtcttccgccatccttccatctgcttggccaaaaatcttgaagtcatccttgatgcccatctttctcacgtgttgcctctaatctaccagtaaaaccttttggctcttcacttcaaaatgtcttcagaatccatccacttttaatcacctccaacaccccaccccagccacatcctctctactaaattgcttctggaatagctcctgattggtctctgtggttctaccctgttcctttacagactatcttccacatagcagccaaagtggccttgtaacaattgtgtcattcctttgcttaaaagccccaggggtttcctgactcatttggagcactggtcaggcacccaccaggagctctgtcttcctccttaccatctccctgaggctcagctccccaaccttcctccctcgcgtgctcagctgcagccacacgggtctcctgcctctttcttgaacacccgcagcaggcccctgtctcagggactttgcactcctttcctctgttaagaatgccctctaggaggattccattccaagatggccaaataggaacagctccagtctgcagttcccagcgtgattgacgcagaagacggatgatttctgcatttccaactgaggtacctggttcatctcattgggactggttggacagtgggtgcagcccacagagggtgagccaaagcagggcaaggcatcgcctcacccaggaagcacaaggggtcaggggatttccctttcctagccaagggacgctgtgacagacagtacctggaaaaacgggacactcctgcccaaatactgcacttttccaacagtcttagcaaatggcacaccagaagattatatcccgcatctggcttggtggatcccatgcccacagagccttgctcactgctagcacagcagtctgagatctacctgtgaggcagcagcctggcagagggagtggcatctgccattgctgaggcttgagtaggtaaacaaagaggctggggaagctcaaactgggcagagcccaccgcagctcagcaaggcagactgcctctgtagtctccacctctgggggcagggcatagctgagcaaaagacagcagaaacttctgcaggcttaaacattcctgtctgacagctctgaagagagcagtggttctcccagcatggtgtttgagctcagagaaaggacagactgcctcctcaagtgggtccctgacccccgtgtagcctaactaggagacacctccccgtaggggccgactgacacctcatacaggcgggtacccctctggggcgaagcttccagaggaaggatcaggcaccaatatttgccgttctgcaatatttgctgttcttcagcctctgctggtgatacccaggcatacagggcctggagtggacctccagcaaactccaacagatgtgcagctgagggacctgactgttaggaggaaaactaacaaacaaaaggattagcatcaacatcaacaaaaagaacatccacaccaaaaccccatttgatgttggtgggtcaccaacatcaaagaccaaaggtagataaaatcacaatgatggggagaaaccagaccagaacatctgaaaattctgaaaaccagagaccctcttctcttccaaaagatcgcagctcctcgccagcaatggaacaaagctggatggagaatgactttgatgagctgacagaagtaggcttcagaaggtcagtaataacaaacttttccaagctaaaggaggatgtttgaacccattgcaaggaagctaaaaaccttgaaaaaagcttagacaaatggctaactagaataaacagtgtagagaagaccttaaatgacctgatggagcaaaactgtggcacgagaactacgtgacgcatacacaagcttcaatagctgatttgatcaagtggaagaaagggtatcagtgattgaagatcaaattaatgaaataaagcgagaagagaaggttagagaaaaaagagtagaaagaaacgaacaaagcctccaagaaatatgggactatgtgaaaaaaccaaatctacatttgattggtgtacctgaaagtgacggggagaatggaaccaagttggaaaacactcttagggatattatccaggagaacttccccaacctagcaaggcaggccaatattcaaatttaggaaatacagagaacaccacaaagatactccttgagaagagcaaccgcaagacacataattgtcagattcaccaaggttgaaatgaagggaaaaatgttaaggacagccagagagaaaggtcgggtcacccacaaagggaaacccatcagacttaacagcagatctctcggcagaaactctacaagccagaagagagtgggggctggtattcagcattcttaaagaaaagaattttcaacccagaatttcatatctagccaaactaagcctcataagtgaaggagaaaaaaaaatcctttatagacaagcaaatgctgagagattttgtcaccaccagacctgccttacgagagttcctgaaggaagcactaaacatggaaaggaacaaccagtaccagctactgcaaaaacatgccaaattgtaaagaccatcaatgcttggaagaaactgcatcaactaacgggcaaaataaccagctaacatagtgacgggatcaaattcacacataacaatattaacctttaatgtaaatgggctaaatgcctcaattaaaagacacaggcaaattggataaagagacaagacccatcagtgtgctgtattcaggagacccatctcacatgcagtgacacacatagactcaaaataaagggatggaagaagatctaccaagcaaatggaaagcaaaaaaaaaaaaaaaaaaaaaaaaaaaaagcaggggttgcaatcctagtctctgataaaacagactaaaccagtaaagatcagaagagacaaagaaggccattacataatggcaaagggatcaattcaacaagaagagctaactatcctaaatatatatgcacccaatacaggagcacccagattcataaagcaagtccttagagacctacaaagagacttagactcccatacaataataatgggagactttaacaccccactgtcagtattagacagatcaacaagacagaaggttaacaaggatatctaggacttgaactccgctctgcaccaagcagacctaagagacatctacagaactctccaccacaaatcaagagaatatacattcttctcagcaccacatcgcccttattctaaaattgaccacatagttggaagtaaagcactcctcagcaaatgtaaaagaacagaaatcacaacaaactgtctctcagaccacagtgcaatccaattagaactcaggattaagaaactcactcaaaaccgcacaactacatggaaactgaacaacatgctcctgaatggctgatgggtaagtaatgaaatgaaggcagaaataaagatgttctttgaaaccagtgagaaccaagacacaacatatcagaatctctgggacatatttaaagcagtgtgtagagggacatttatagcactaaatgcccacaagagaaagcaggaaagatgtaaaatcaacacctagcatcaaaattaaaggaactagagaagcaagagcaaacaaattcaaaagccagcagaaggcaagaaataactaagatcagagcagaactgaaggagatagagacacaaaaaaacccttgaaaaaatcaatgaatccaggagctggttttttgaaaagatcaacaaaattgatagactgctagcaagactaataaagaagaaaagagagaagaatcaaacagacacaataaaaaatgataaaggggctatcaccactgatcccacagaatacaaactatcatcagagaatactataaacacctctatgcaaataaactagaaaatctagaagaaatggataaattcctggacacatacaccctcccaagactaaaccaggaagaagttcaatctctgaatagactaataacaggctctgaaattgaggcaataattaataggctaccaaccaaaaaaagtccaggaccagatggatttacagctgaattctaccagaggtacaaagaggagctggtaccattccttctgaaactattccaatcaatagaaaaagagggaatcctccctaactcatttcatgaggccagcatcatcctgataccaaagcctggcagagacataacaaaaaaaagagaattttagaccaatatccctgatgaacatcgatgtgaaaatcctcaataaaatactggcaaaccaaacccagcagcacatctaaaagtttatccaccatgatcaagtcggcttcatccctgggatgcaaggctggttcaacatatgcaaatcaataaacataatccatcacataaacagaaccaatgacaaaaaccacatgattatctcaatagatgcagaaaaggctttcaacaaaattcaatagcccttcatgctaaaaaatctcaataagctaggtattgatggaacgtatctcaaaataataagagctatttatgacaaacccacaaccaatatcatactgaatgagcaaaagctggaagcagtccctttgaaaaatggcacaagacaaggatgccctctctcaccactcctattcaaaatagtgttggaagttctggccaaggcaatcaggcaagagaaagaaataaagggtgttcaattaggaaaagaagaagtcaaattgtccctgtttgcagatgacatgattgtatatttagaaaaccccattgtctcagcccaaaatctccttaagctgataaacaacttcagcaaagtctcaggatgcaaaatcaatgtgcaaaaatcacaagcattcctatacaccaataacagacaaacggagagccaaatcatgagtgaactcccattcccaattgctaaaaagagaataaaatatctaagaatccaacttacaagggatgtgaaggacctcttcaaggagaactacaaaccactgctcaacaaaataaaagaggacacaaacaaatggaagaacattccatgctcatggataggaagaatcaacaacgtgaaaatggccatactgcccaaggtaatttatagaccatctccatcaagctaccaatgactttcttcacggaactggaaaaaaactactttaaagttcatatggaaccaaaaaacagcccacgttgccaagacaatcctaagcaaaaggaacaaagctggaggcatcatgctatctgacttcaaactatacgacaaggctacagtaaccaaacagcatggtactggtaccaaaacagatatatagaccaatggaacagaacagaggcctcagaaataacaccacacatctacaaccagctgatctttgacaaatctaacaaaaacaagaaaaggggaaaggattccctatttaataaacagtgctgggaaaactggctagccatatgtagaaagctgaaactggatcccttccttacaccttatacaaaaattgattcaagatgggttaaagacttaaatgttagacctaaaaccataaaaaccctagaagaaaacctaggcaataccattcagaacatagacatgggcaaggacttcatgtctaaaacaccaaaagcaatggcaacagaagacaaaatagacaaatgggatctaattaaactaaagagcttctgcacgaaactaccatcagagtgaacaggcaacctatggaatgggagaaaatttttgcaatctactcatctgacaaagggctaatatccagaatctacaaataactcaaacaagtttacaagaaaaaaaacaaccccatccaaaagtgggcaaaggatatgaacagacacttctcaaaagaagacatttatgcagccaacagacacatgaaaaaatgctcatcatcactggtcatcagagaaatgcaaatcaaaaccacagtgagataccatctcacaccagttagaatggcgatcattaaaaagttggaagcaacagatgatggagaggatgtggggaaatcggaacgcttttacactattggtgggagtgtaaactagttcaaccattgtggaagacagtgtggcaattcctcaaggatctagaactagaaataccatttgatccagccatcccattactgggtatatacccaaaggattataaatcatgctactataaagacacatgcacacgtatgtttattgcggcactattaacaatagcaaagacttggaaccaacccagatgtccatcaattatagactggattaagaaaatgtggcacatatttaccatggaatactctgcagccataaaaaaggatgagttcatgtcctttgcagacttggatgcagctggaaatcatcattctgagtaaactgtcacaaggacagaaaaccaaacaccgcatgttctcactcacagatgggaattgaacaatgagaacacttgaacacagggaggggaacatcacaccctggggcctgtcatggggtgggggcctgggggagggatagcattaggagatatacctaatgtaaatgactagtttatgggtgcagcaaaccaacatggcacatgtataccctatgtaacaaacctgcacgttgtgcatatgtaccctagaacttaaagtataaaaaaaaaaaaaaaaaagaacgccctctaccagatactgtgagacttacgccaccctgccttcagctctctagcagatgtcgtttgatcagtggggccttcctgaatataaatatatgtaatataaatatatataaaaacaaaaggcacctcaccctcttactgctagcatcacttacgccctttattctgttttctttttcctcatagcacttaaccaccaccagacacttgtgtgcgtgtttattatctatttcttccaactagaaaataaattatataagggcaaagatgatgttttgcttgctgctgtatcttcagctccttaggattgtgcctggcaaatagtaggtaataaacagttgtttattgaattactagaaaaaaatctctaaaatctgtagtcctgcagcatgtgaagaaggaatattagactctgcctgcctttctgaaagtgacatatacttaagtgatgctaataggatatgtaagaacatgcttcatatgtttgagccttgatgatctctgacaggagaaatggggtaaacctttttttaaaaaggacagtataatctgttcttggcagcagctttctataatctaggaaataattcaatattattaattttcgaattagatatagtcggccgggtgcagtggctcacacctgtaatcccagcactttgggaggccaaagcaggcggatcatctgaggtcgggagttcaagaccagcctgactaacatggagaaatcctgtctcaactaaaaatataaaaattagccaggcatgatggcgcatgcctgtaatcccagctgtttgggaggctgaggcaagagaattgcttgaacctaggaggcggagattgcggtgagccgagatggtgccattgcactccagcccgggcaacaagagctaaactccatctcaaaaaaataataataatagtaattagatataatcgtttttcattaaattccttcactaaaatcaaatggtaactgtgctacttgatacctttacttataaatagtgtttatgttatatggccaaggtcagtataggtattgttaatgtgataatggcatttgtttattaatttgttatttattggttattggagcagattactagaaggtaattcaagttttttgactattctgtgttctcatcctcagtaatgatcattccaggttgataaagatctgttctgttttttaatagctccagaggagaaaagtttattctctttttgaatgattttttttttttatgtatcacttcggcacctattcaatgtgtgcacaattactatcgcccaggagctcctggctgattactatgatgtggcatgagcccaaatttggcaaggttcacttcccaaggctggaatcagggaaagaccggtgatggccaaagtggtcccagaaggaagggaaggaatttatttatccctacactgctgcatttggaaggctgttggtgaggagggaaaggaagggcaaacattctagaccaaggagttgcttgaccgaagacacacaggttggggaagaggaatagggtataagagtgtgaatgggacagaaaaacaagagagttccacagggcccaaggctgggaagcaggctgggggacaggtaatagatgctgtgcaggggagtttcagcatgagaactgccatttcaggtttaaactctattcactgggcttggatacaatgaacacccctgtcatgtcagtttatacccatttcttcatgttctgacacttgaaaactattattttttagataggattcttgagtattttaatttttctaaatagtgacacatacagtgtttctttgattacaaaagtctgaaccgaagttgtttaaagctattgcccctttaggaccacatatatctgacttttatcctgggttatgttctcaaatgttctggagacaaaagattatagggcttttaatctgtgacccttgaattttcattgttgaggtttgttgtttgtttgtttgttttttgctgttgctgctgttttattttgtagtgggaatttagacagtaatgacagaaagaagcatgtttcattaagtggatgatcccattcagcaacaataatactaatactcccacagagccaaagccttttttctgggtggatgagtgttttataaaagaagtacctcaggacttcagcctctctcattctccaccagatggagtttaacagtttggatggaaagtctgaaatgattttcccttgtgatatcccgttttttatgtctatgtataaatgtataatgactaatttggaaatagcgctatcaatttattaaactaggaagcattatttcccctggaattagtttctgctctggcccaggatcactgtggtgtagaactttcaccacagaatagcctctggtaaaagatgaggcctgtacttgtcctactttaacgcttctgtatatgttttaaaaccttgccccaatcaactctataagaatgttataaagagagcagtgtgttatgaagtgtttcattttactaacaattttattttccaaagaaaaatgcaaatgattactatattagacatacagtaggagtagaagaagtggctgacttaaaacatgatgaaggagaataaaatgtttctggtgctacagtttcaagttttgaagtggacagcccagcagaacaaagctagggagacctgggggctggtcactgtcgagtgagctcatgtgcctggttcccccctgcatcctcttcacaccccgatgcgtctccacctccctcatcataggggatacctgcccctcttggggagcaggctcttggcagcagctcttttgagaagtgagccactatgtaaagcctctgccattcttgagagtcctgcctgacagtgtattctccattttcttagcccagtcagtgaggataagtgaaaacattgtatcgtgtaaagtgggatattttaacacacaaacttgctgtcttttccttttaatggtgaacaaccttttgtggtatcatggggtcttgatatcatctctcatcttcttaatctaacataattcgaatattagtcatgttacacaaacagactgctagaaaccacaccgggatttcatttgctgtgtgtcaacagtagaaattcaggacaatcctctggttttgccagcagtaagtttccacaacagttatcaaagtcagcctcttttattccaaacagtgattttggtggcttttcagacacctttcattatgtcttcacacctgcagttatcgaaggatgtctggtctagctatatgaaaactgaaaatccaaaataacccaggaaactcttttatttcctgggttctcccaaacacagtcgaagtatgtcgtttcatcatgctaacagattatagatgactattagataatatagtgctgaaagaaaaatgtcccacatcaggagccacgtgtcttttcaggaaccagtactatgaaacatcaagtcttgatcagtatgaaaattgtcttctctgttttggtaggtacacttcctgtttcctaacaacagggtggtagtgacatcagtagtggggtcctgccgcatgtgaagagggaatattagactcagcatgcttttctgaaagtgatgtatacttgatactaataggatatttaagaacatgccttatatgtttgagtcttgatgatctctgacatggaaaatggggtaaacctttttttaaaaaggacaaaatttgggagacctgattgtaaatctaaaaagtcacaacccctgccagagtttgcagaacagtagccagaaacctaaggattgtgtttttaggtttataggacacatttgggggcttagtcatttaactgatcttttctgtagcataaacataatcatcaccaggaaacgtctctgagctttcattcattaaacaaaatgtactaaacacttaagaggcagtcagtgttactacaaagcaccccagtatagtacttattttttaaacatcattaccacttggtaatatctccgtcagctcatagcgttctggaaaaagcccaggtcttatgctgtgtttgtgctgagttgctcccttacatgtgcattgttttgtttttcactaaaggttttctccatatttctttctaattaatgtcagtgttttccaagcattatcttcagtcttttccttttaaggatcctagacctgttctctactctgccaaccacaccatacccaggttatcattcaccatcatattgtgcctggtccctggttgataaagagtgttcattaaagggtgatgtgaaaatgatgtgatgaaaggccacagaccccttctgaattctttaccacccttagcaacagcaggctgcgcggtacctgtcttatcttttagcagatggaattcatgttctaattctcaatggaataaattaggggatgttgggaaacgtttgcgtttaatgaagcaggaggaattatacatttttataagccagccattaaaatgtggacattcggcatttaaaagaagtttctatttagtttaaaactagcaacttgagctgcaatgataagaaatgctcatgggaagcctaatccctctgctccactgcacattcccttgttttcttgccataaaacatgatatagcctcgggaattttgttctcctgttcttggggtattagtgactacattttagttttcaccttttgtgtcaaaattcaagccgccagcaatttgcttttcatcctttgatccgaagaatgttttcgtcaacaaatgctggacttcagtgcacggaatgttaatgtgtaccctcagccgccagctaggagaaccgtttaatatgacgaagtgcagtgagaagcattattcttgttggagtttaagtacttacagtaaagatgatgtttgatcacaggttttaaaacctatatcacatttactcttaaaaataatttaggtgcatttttaaaaattactagcaaagctttttttccaaatgaaacctgtagaatatattatcatcgggatttttatagaacacattattactctttttaagaaacacttccatgtgtagaatatgaaaccataataggctttaggatttatacttaaagcagtgctaatattattttgaatgacacgcacgtgacacagtattttggtttacttcctaaagttaaacattaaactctgccccattatgtttttaatgatgattttatctttaaaatatatatatataattgtattcacattctttaaaaaaattttttccctaggttgccattgtttatctggctttcagagcaatatttctaaacatatgtgaaaaacaaaaacaggcaaacttcaacaacaaaagaaggttgctactgagtgtacgtgggccaggttgctaccctcgggagccccttctctcagggagcccctcctgctgcttttgcgactccgactcttccagcaggtgtcactgtctggcagcagtgggcgagcaggttgcggttcacctgactcatcttcaaataataacttttaaaatttatctttagggaagttgtttgacgtaaatgtatcaaaactttgacaaaaatgttgctacatcatatgcctgatttttccctcatgaattgaaattcacagaaaataaaggaattaatcttgtgctgatataaaattttattgagtattagaaacatttgtttataatgagaggggaatgtggctgggaggacataattaaatgaaacttttaggaccatttatttatgaatttgctaagcaaatatagattccttaggtctgttctagagtctctgatggctgcaaaggggtaagccacagtgcttaccctcctgaagtattagtgtgtattatacacaccaagaaaggaacaattgtaatagaaaaggagaaagtcagtgtatcttattggcataatgacagggctcctaagttcatagaaacctgtttttgaatcctggctttgatgcattctaatcatatacagtacaagcgtcttaacttccttgtggacgatgggtgtggtatcaactctgtcatgggtggtaattaggtttaaacctggagggtgatgtggcatagatgttggcaaactttttaatgtcaagggctggatagtaaatattttaggctttgcaagccacctattctctgtcatgaatactaaactgtgactgtagcacaaaagcagccacagacagtatataaagaaatgagcctggctgtgttccaataaaactttatccacaagaaccagtggagagccacatgcagctggtgaccatagtttgccaatccctgatataaccattactcacctgtaatcccaacactttgggaggccgaggcgggtggatcacctgaggtcaggagttcgagaccagcctggacaacatggtgaaaccccatctctactaaaaattcaaaaattagccaggcatggtggcgggcacctgtaatcccagctactcgggaggctgaagcaggagaatcgcttgaacctgggaggcagaggttgcagtgagccaggattatgccactgcactccagcctgggtgacggagcaagactccaagacttcatctcaaaaaaacaaaaaaagacaacaacaaaaaaaccagttactcaacatagtatcatagttgttacattaagtaacatgcagtagcaaagtaagcagtatcacagagtcatatatgacaagtgttttgagtccataacaagtcctcgttcttgtcctcgcagacttgttgatcccaggcaaggcacttttcctttctgggtcttttatcagtacgacttttgattcagcagcagtagtcttgtttagggggcaggggcagaggttaagggggacagggaagtatataaaggacttttattcttatgaatccaaacagagggcagagttgtctgtgctttgttttggtgccatggatgtttaaaaggataccattgtcttctgttcatttaagctacccattttatcttttctctgttacccagaatatcagtcctgtttaacaaatatgtaatgattcaaaattcatttgcaggtttttaaactttgacagtggtctcctctagcagagatttcagatactatgtattcagagacagaaacatcattctgtgcttatctcagtgaaagaaacccaggaaaggaatcccagcccctcctacatcctctccaagctacaggcatgtggctcatccaggaggggagaagggagcagagaagccaccctgggtgtcttctcacccatactgctaatcctgacctgacctgaaatttaatataatcaaggcaaaatcagattaaaatggagccaaatagttttacacttcaaatagtttttacgtacataaaaaatatatggtgttcgttttaaattattcatattatttgcatatgctaaaaaagaaatcagcatgcttcttgaaatgtcttaacaatttaaaatatttataatataactgattcttaaacttttatataatgcagtatatttgaaattttaaaagttcaattatttacattctccttgggaactacattttatatattctgttacttgtaatcaaataattatatgacattcttaatgtctgtacctacaaacattgaattcatgcatatttataaggtagcttattgactataattcattgttgacctttctgatgattctgtagttagatttttaaaatatgattgaatgtggaatatctaggcatagactaacatgggtttgaatcttagctgtgacatttatgagctgtgggctcaacactttaaaagtaattaactgcatttttcatcttttaaatcattctctgagaaaaagtcaactccttaattagtccttgtttgaattatgatcaaatagtattggtttgtacagaatgatgctaacttaggatccaggctatagatggctgcaaccggaatagagccatttagtcatcatatgtacaatagagtaagaaatgcaaaaaaaaaaaaaaaaaaaaaatagatacaagataagagcacttttaggttctaagaatttaaaatgtgtatctaggttagagtgaattggggtgaaatttcctgtgcttccaagttaaccagtagaagtgttgaaattgatttcaagaattgatagtgtcctattaaacaatcagaagacagaaggtactagtgagaagtcttgatttgactatggggctaatagggaggtgcttgttgtgcaagcttatgtgagagaatagctgtatcagtagagtaaaagaccctagagcgggctgggtgcagtggctcacgcctgtaatcccagcactttgggaggccaaggcaggtagatcacttgaggtcaggtgttcaagacccgcctgaccaacatggtgaaaccccgtctctactaaaagtgcaaaaattagccaggcatggtggcggatgcctgtgatcccagctactcaggaggctgaggcaagagaatcagttgaagctgggaggcggaggttgcagtgtacatgtgtattccatatatacaagtgaagatatgaatccatactgataacttccagtccagcaccactgaatttattctagtcgtctccatttccttctcttcttcacccacagtgagaaacctggttcgcacctacagtatgtttacatatttgctcagttctagtatataaataaactagtttcagaaatccttacctttactcctgtaagaaacagatttaaaattacgtgcagcgtgtgccattcttgtctctagccttcacagtctccagtcaaaaccctctttgccaaggttatctaggacaggaccttactttccatgcccttagcgtggctgtgccatccatgcagctgcagtcagagccgtctgtctcagcttgcattcctcttaggttcacctcacatcctagttgattccgtttttatttacttacaatagaatttactttatggtgtatagtacgtggtttctgacaaatgcatagaattgtatgttcatcacatggacacaaggaggggaacatcacacaccagggtctgttgggggtgggggacaaggggagggagagcattaggacaaatacctaatgcatacggggcttgaaacctagaagacgggttgatgggtgcagcaaacctccctggcacatgtatacctccatggcacatgtatgtaacaaacctgcacatttgccacatgtatccctgaacttaaagtataataaattttttaaaaattgtgtgtttatcccacctttcttttctaatgttggtaatttgtatcttctctctctctttcttggctagtgttaccagagaatttttctaagaacccagcttttggtttccttgcctttctctatttttcttttttcaatgtcatcatttctgttcttattttgattattttttccctctccttgctttgagtttagtttgatcttctttttctgatttcttaaactgaaaatttagatttatccgagaaccttcttttctaatgaaagttttgaatacgataaatttcccactgaccactgcattagttacatcccacaaaattcgaatgttgtgttttaattttcatccagttgaaaatatttgacatgttttgagacttcctcattaacccaatgaatatttagagatgtgttcttttttttcttcaacttctaagttcaggggtacatgtgcagggtgtgcaggtttgtcgcacaggtaaacgtgtgccatggtggcttgctgcacaaaccatctcatcatctcagtattaagcccagcatttcttcctgatgttcttcccccacacccctatcaccccccaacagacaggccccagtgagtattgttccccccaatgtgtcctcgtgttttcgtcattcagctcccacttataagtgaaaacatgcggtatttggttttctcttcctgcattagtttgctgaggattatggcttccaaatccatctatgtccctgcaaaggacatgatctcattctttttgatgactgcagagtattctatggtgtacatgcaccacgttttccttatccagtctatcattgatgggcattcaggttgattccatgtctttgctattacgaatgaacatatgcatgcatgttatctttatagtaaaatgatttctgttcctttgggtatatacccagtaatgtgattgctgggtcagatggtatttctgcagaggtctaggtctttgaggaatcaccacactgtcttccacaatggttgagctaatttacactcccactagcagtgtcaaagcattcctttttctctgcaacctctccagcatctgttattttttaactttttaataatagccgttctgactggcctgagatggtatctcattgtggttttgatttgcatttctctaatgatcagtggtgttgagcttttcttcatgttgttggctgcatgtatgtgttcttttgagaagtgcctattcatgtcctttgcctgctttttaatcgggttactttttttcttataaatttgtttaagttccttgtagactctggacattagacctttgtcagatggatagattgtgaaaattttctcccattctgtaggttgtgtgttcactctgatgatagttccttttgttgtgcagaagctctgcagtttaattagaccccatttgtcaatttttccttttggtgttttcgtcataaaatctttgcccgtgactgtatcctgaatgatattgcctagattttcttctagggttttcatagtttttcattttacatttaagtctttaatccatcttgagttaatttttatatatattgtaaagaaggggtccagtttcagttttctgcatatggctagccagttttcccagcatcgtttattaaatagggactctttccccccatcacttctttttgtttgttgaagatcagatggttgctggtgtgcagtcttatttctgagttctctattttgttccgttgatctatgtgtctgttcttgtaccagtatcatgcatgtgttctttaattctgcaataatttgatggtttttcagatatcctccaattaattgatttctggtttaattctgttttcatgtaaaaacacactctgtatggtttctactgattttaaatagttgaggtttattttgtagctcagaatatggtatgtactggtgaatgttccacatacccttatataaaaagtatgttctgctgttgagtggaacatttctataaatgtctattaggtcttgatagtgttttgcgggtcttttatgttcttcctgattttctatttatgtgtcccattaattaccgagagtggattattgaagtcttcagctctgattatggatttatttttttcagtttccgctcctttatttcgaagctctattgcgtacacacttaggattgttatgttcatgggatgacctatatcattatgtaatgctcctgtttatccttcataatattctttgctctgaagtccacttcgtctgatattagtatagtttctgcagctgtattttagttattgatttatggtatatctttccccaaacttttattttcagcctacttatgtctttatatcaatatttaaaatgcgtttcttatatacagtatatacatgggacttgcattttattcagtcctagtcatttctgtcttttaatttatgtgttagaccaccccttttaatgttattatttgtgtaattggattaaaatgtaccatattggcaaccgttttctgtttgtttcatttttgggtttcagttttcttttgatgccttctctagtattaactgagtgttttttatgattctgttctatttcctctactgacttattatttatacttttaaaaaattgtatttatctaccttcagataatattacattgctttacatggagcctatagactttactgcagtttatacacagctccttctttccgtgctttatgctattgtggccatacctttttacatttacatctactgtgaacgcacagtacattgttttacacattcaggtatcttttagagcaattaaaaaataagaaaaaaaattgtgtccccatttattctattttcactgctctttgtttgtttgtgtagatccgggcctccatctgatgttgtgttccttctgcctgaggaacttccgtttaacatttattgtccactaggtcaagcagctggcaatgaatcccctcagtttttgtttttctaagaaagtctgtatttctctttcatctttgaaaattattttcaatgggcatagaattctggatttaacagttttcttgatattgttaccatattttttatttgcaccattttcattggattctttttaatagttgtcagcactcagctgaaagtcccatctgttattgtctacctttccctttagagccttcaaaatatgaaccatagttattttaaattctcagtcatttctaacataggtgtcatatctgactgtggttctgattattgctttgtctctctgaagtatgtttttttcttgccttcttgtatgccttgtaattttgtgttgaaagctgtacatcttgtgtaagacagtagagacccatggaaattgtttgtatcctagaaatgtgcatgcctctccttcctagaggcctttagtgtgggagttagagtttatctagttaggagtttgctaggtttgagagatttgttggcagctatcctcactgcaggaaaggcttcatgttcctgtagagataccttgtgttttggctgggggttggatcacaagaacatcacctgttcagttctagttttaggtcttccttttgcactatgcctcagaaagggtctctctgcacattcttgttctcctgtttctctccaagcactgttttgttacctgtaatgctaagctccttagcttgacattgtggggcaaggaggaggatggggtgctgtctctgttccgattgagttacagtctcgtacctgcaccattttcttaggtttctgggctgtgaccttctcagttctcctccctctcccccaagtgttgtgggagtttctgtgtaatcctgtccctccccaaggagacaggttgtatgtgtatgtttttcctgttccctttccacactgcagtgagttttcagcagtgtcctaaggacaacagtgcgtgccgcccttctcctcacaggataggtcttttgttttcctggtggagacaggggagatggatccaggtgtagttccttgccactcctctagagttactgcttctctcccccatatctggaacacagcggacacttcttaccccaccctcctgtgagcacctgggtgatggtcatggcatagatcctgtgtgagaatgtaaccctcagaggtttcacacaatcttggcagcccactcttgactctaaccagatacttgagcgggactcccctgactggggttctgttgtgtctgccctcggtgacacaagcttgtgtctccttagattttgggctgttgattatctgggacctcggcttattgatgggtttggaaaaagttaataagtttaaagttaggctgtacgtgtgtgtgtgtgtgtgcgcgcgcgcgtgcacgtgcacgcttgtgtgtgtgtttaacgtaaacaggtcccatccttgttagactttacagcaagagcagccttgaatgaaatcatcctttctctccagtaacttattctcccagtcattcagttctctttagtctttttacaaattttacttctttaaagaagatgcgtctccaaaaaaaaaaaatacctaatttgctactgatgtggcaaattcaagtcaaattgaggatgactcgaattttacaatgccaaacaatcctgatggccaactgtcttattcttccccagggccttctcctcagccagggcggaggctcgttgtgggcagggtccttgtcttttataatcctcgcagagttgccaaacctataaaaaatttttaaaataggcaaggtagagaagtagctgaggtgcaggagtctgggtatttacccagaaatcacacattctgtctccagcataggcccctagagccagtcaatactttggtattattttatttcattacttattttacagcataatagtagaaccctaaaagcaaaagccttatgaaatcacatgctaacagaacctaaatgcatgtttcatcttagagttttttaattataaaagtagcacacgtttgtgataaataatgtaaaatgtcaagttcttttcatcccctagaaataatcaccctccaatcttttctatgggtcttctaaggcttttctctaaactcatttttgtcatatacaaagaaaaagtaaaaaattaatatctaggccatttgggaaaggcagcctattgcttgttgctctgtttacatgtttgtctcttttcaaaaaaatacctgtaagtgcagaatgtatcacagctaaactgtacattgtctaatgtcatctttattatatctcagtgacattcctcccccataactaaattttattaagctttcagtgggaaagagcctctaatttgcaagattttgaaaatgtgaagagtttaaaagttccacatgagcttatgagatttttgaaactatttcctggatcatcttgaagattccttgttaaactcagtttcacatgatgttaagaggctgatactaacgacttttagataatatccccctttctatgaggaatgggttgaatcatatcacagaagaaattgacaggaaattgtagcatctctctgagtaaataagaaggcttacacattaggtgaatatgacgacacggaggaccattgaaacatgcctgtgtcaaccaaaagaagaagctaaagcacaaagtgtggttgaaagagttgacttgagccagaataaggacagctgcccagatgactcacccaaactgcttgcttggcctttgttacaggcagatttttaaaggcaaaaagaaaaaaacaaaaacaaaaaaacaggaggcaggggaggggggccggtgttaccgagtagactgttagacagttctgtcaggaattctcatggatatacagaagtaacagtgattagtgactgcctgtccacggttaagctatagaatgtgggatatagtgtccagtgccacattactaggttaattcacagctacctgtggcaatgggaagcagcttcagtaaagtgtggagtaggatgtgattgctgtctcatcttaatgcctctttggggcctagtaatttgaaagggcccacattcctcagataaaagtccttttctttcctcatctataatactattcaaatctaaagaaaatgtatgttgctcacagataccaacagccatcagttttttgtgtttgatttaatttgttcagtaaaaggaagatacaaaatagggaaaaagctcaggaaaagagttgcgttgaactctttattaattttatatgtagttcagttgtgttttaaagattttcaagtgcaatcttagaggccttcatttccttgtttcttgattaccctccacctgcctcattccccttctgagagtcatttcccattcctcgtccctgaccccggcccctcccgcagagctgccctcctctgaatcctgatggccaactgtcttattcttccccagggccttctcagccagggcggaggctcgttgtgggcagggtccttgtcttttataatccttgcagagttgccaaacgtataaaaaatttttaaaatagcacttgtgcacttggaaagcattccatcacatacctcttggttgtttttattagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacaggtaaatgattggcagttgttcttttatttcttttttcgttttaacctattaaatatggagaacttaatggcttaagaaaataatgcacttaagtgatttttttaggccaaatcagtttgtatagctttatttttttcttgtatttaagggtagagggtatttttgccctttggagtcttgttgagtatcttaagcagttcagatattttattgtaaatctatgaaagaaccaaatggttcttgaaaaatacacccatttatttttatttgctttttgaaaaatttttgaaattaaaaaaaaaaaaaaacgtgacagtggcgaacacaagtcccgcaactgatttatctgctggccccttctgagcagtttctccactggtgctgatgtgatgatggattttcactgacttacccaaacattttgcactttgcccccattggcaagacagctaccagtttctatggcaaagttaatgtgacccgaaaacacatcaagaagttcactttgcttgaattatcacattgctacagcagcttgggagagctttctgcccaagaactatctcaaggcaggcacaggcctctgaaaagtcacgctccatgtgctgtgagtgagtccctgctctacctctggctgttttgtgacaaatgattaattctgggaggaatacattcttccctcattgacagttctcttacctctagtatgtattgaatattgcaataggatttatgcctaattgtggcagattgtgctgtaagcgtctctatcccaaaacctctcagacacttaccagtgcctggaaatctggttttcagtagacatttcataaacttgcaagtgatagacaaacaaccagagaactttttcatagtaacatctcttcacaaataattctttagttcatttttccccattgagttgacatagccaacttgaatctcaatttctcagtaactcttaatctctaaaataaggtggagctggtagtgccagaaacagaaataataacaaaaatagcagcttaagaatatagctgtgtccacttctcagagttattctctgtgtacaatatgacaaaatccaggaaatttgcttcagacatgcaaaagactatacaagatgtattgccattatttctaccagaaacgaaattaaagatgtaataattgtttaattggaagcttatttttaaaaatcgaaaaataatttcattgcagcaaacatcatttttatcaatgcaaatatacttacttttatctcattgtgaagaaatagatttagcactagctttatatctcagtgattacaaaagacctgtcataaaaggattgctctctcttgtcatttagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttta

SEQ ID NO: 1742 - DNA, 193735 bp, Homo sapiens
  source 1..193735: mol_type = genomic DNA
tcaagcatgtaattgtatatttatttctctttttaaagaacactccttaatgtaattcaatatacaaacttggtttcacagaattataatccactatatagcacaaagataacccagattgtatgtgtgcgtgcacacatgtgcgtgcctgtgcacatgttgctgcacccctccctctctttcactcttctggacctacaaatgctcttcccaccttcaacactaaccaaaagccattgtgagtattacatacaacagacatcctcccacgagttctttgcccttgaaagattcttttccccattccccctgagatagccaggagtgtgacactcttcccctatgaaaaagggtaaggtgacctcccctaacacagatgttaaccctgttcccatgtaaaccggctgacaggaagagctggggagcaggtctccatctccttttcccccttccacacccaaccctcagagtccaagtgcgaccctctgtgtagccttagttccagtcaccatcctgtgtagcaagaactaaggagattgctaagcccaggtcttctccatgagcagcgcacagcactgcctgccaagccaccgggccggccgataaccaagctctacacagtcccatgtgctttgtcaccttaattttttaaagacacctagcataggtctgtggcaacctagtgtccaactgagttacataaaattgtaccagtgatgcacttgtacatatttacatggggtggaatgttttcccatatttttagatgagtatatagatcaacatgttcacataagaccaaatacttttaatattatttataactgatttataaagctttgaaaaaactcacaatagcacattgtttactttaatgctttacggtactatcattttaaaatcacaatcagcacttaagttatagtcaatccagcaaacaagagacaaaaaaatatacaagagttaagaactgactgatacatcctttatctttttttaactaatgcataagtgcagaataagatactctagtttaaatatcttgtttacaatgtacatttttgttctagttacgcaacagtaaatcccatgcttcacatagaaaagcaatccacaacattaagaaaaaatgtacaatttatgaaacaaagtaaataaatattagtattacagaatcagagctgtacataaaagctgttcagttttaatcatataaaaatatgttttagtgcaacctcacatatatattgatgctgttttgctttacatcatttagatccaagtgtccaaaaaaggaaagaaattacatttattacaaagcagatacacaaattctaaaatatgtacaaattactgctaaaaaatgcttataagaatataagcaaagtaaagaaaaggcacaaacatctgtacaattttaaaagtaccagacccaataggttaatttcaaattttgttttggtcaggctcatgatgacttgttaatttacctaattcttttgatataacaaaagtatatataatagcaaactactgtaacttaggacaggcatgctataaactggattacctccatttctagaaaaacaaaaacaaaaaaatgggaaaatgtggaaatgaaagtctccatgcatcatagatcaatgtagctgactcttttctgatgaaggatctttgctttcctctgtgcttgaagataattccttgctgctgtgaaagtccaactgcttgtcatccacacaactcttgctgtaaaacgtggagtgagctaatggagtctgtgatgtaccaaaattgtccttttcaccatcatgcaagtcagggtgggtggctgaggtacagggctgacctggctcaggtctactaaagtgtctaatgctaacatgtgcacttcccagggggttctggtggggctcctgcacccgcgctggctgatctggcccgagcagagctgcctcttccgtggcaatccggagagaggcaatggcttttgtacaagtctgtatattttcctcctgttcccgctctgttgcgtttaggctgtcttccgaagtgctctgtttcatcaacagccgaggagaggagggagtgctaggtggaccagatgactgcaaagcgtgaggacctcgcttctcatgctgcttagaaagcacataggggtccttggagaaggactcccctgacgcgcctttcttctcctcaaagccctccattggcaggggcaatgtgggtgaaggatgtaaactggaaagggctggcggcatggagtgaaccatctggatcccaccaacgggcaccatggggataggggctcgcacttgttgctgagagtggagtggaagatgactgaagacatagtcattaggaccctcagggaaaaggctggagcctggatgttcataagcaccttcttggtctccatagagactgaagtaaggaacctgaggtaatcctcttcttaaattctgcgcagagaaacaaagagagcacaaaattcagagcctgctacgcttcattcttaggtcaagctgttggattcattcactcacccattcacacattcactacctagagaggcttcaatacctaattctttgatcaagttttcctatttcaagacaaaagagatttctctgttctcttttataatccttgaataaaggtgtcggcctgtgaaaagttgcttttgtttttaaacagcaaggtgataaagcagtcagggtgttttccattgggtacagagacacatttcagctctgtttttttcacaagagataatgaaaagaaattaatggataattggcaaaaaaaaaaagtttactgagcaaaaaacactaataaacattaataatattttttttaattcaaaaggaaataaaaagattaccatctgttgctatactggacagatttttaatatttttcttaagtgttgatgagtatataattggaatgacaagtctgaaaattggcttttttaaaaagttttccacagaacagatgacaaaacagtggtgaggatccacaaactggttcctccaatgtgtaagacattggtctaaaggaatgcattcctgctaagagatactcaatgcagaaggccagcttctccatccaataacaaaccaagtccatttaagtcttacatcaataataattttttaaaggaaactatccatcatagaagtagttaacattatttcagacagttaacaacttatattcgactctatactgtgaaccaaagatgactgcatcttaattcttttgttcatattatcatttccacctcaatatcttcttggcaatcaatgaattaaggatgcttaaaatgttcagccagaatttcagatttcatagtcctagtcctgaaaatggagaatttattttctatactgtttctgtagtgaaatacaacttagattgtcagattatcaggttttaatattatcatattttaattaatgtgattcattctttaatggattgtcatctaaaaaggacttcatttatttttctattttttgagaaccaaagatagatagatagatataaacccatacagtatggtagtagtccaggatagagccaaagaaactgttctatttcaagagtttcagttctaaaactcaaggtatgctctgcagcattaaagattcatccagttctatctagattatgatttctgctactctctaagatgcttagcccttacccttctctgtgatatatcatatgcaagctggaaacatggattctcctgaaagtgtgagtgaaacggtgcaatcattaacactatcgttaccacgacctcataagctgggaaaggtgggaattttacggtatgagaatcatttaaattctgcacatagacaaaatcccccttgtatttaatcaggtttggaaaaggcacgtctccttcatcaaacaccagtttgggaggaagacctgtaatgcctacagtaacgatctttgaagataatcaagtacgttttcttttaatcacagcaatcacagattcaaagtttaaaataaaaccgagcttggttatttttctgttttacttctggctgctattccatgacctccattgcatacaaccagtcagaatgtggatctgtggggaaaccaaggaagtggaacagaagtcagagagagagagagatgtcctattacgtaaactgacttgagatccccaaatccaggctgacaaatggagtcatgaattgtcctctaaaactacaataatactcagcatgttctaaatccaataaaatcttattagtgctactaatgaaagtttcaaattcagcccttcactgattttaaccacagagctacgtgtacaagtagaatttctaccatgtggccacttccactgctccaagccccaccaggcatttctacacatcctctctcctctcattcaccccttcttcatcctccaaagaaactcccaataagttttctctactttggtttttactccatttgcaatcctattgttttgtaatttgggccttataaatgtggtggacaaacttccatcttacttaaatctcagtaagaaaattttgtcgtggaaaaacaaatagtgaattcaaatgtagattatgttaagtgcatatgtatgtatagacacatatacacatatgtacaaatgtacatacacagatatctatatacacatctatacgccatgtaccagatctattaccctacgcatctcttcaacagtatggcagtagggacctctagatgcaaatgatgagagggaggtagaagagcaagagcctccttgggggcagcagggagcagagaaggagaagtgacccatttgtgctcagtcactggctggggctgcagggagagcatggctttggcttcaaaacagtcctgtcctgaaggtgctgacatgccagcaggaggcttgtctgcccactacattccttacagctgaatggcacgttctttcaggaacaaaaatctgcatgggccacctccctggctgccagaaacaaattaaaaaactgtggtcaagaggttaagtgactcgcccaagatcacacagataacaagggataggaatgaatgttgactgtttccctagacacaatcttcatctacactacatactgagggcctggacacacctttgtttctcttcctgctacctatctacaaaagctttaaaatggaaaaggaaatttatttatcaaaaaaaaaaagataaggccacagccataatattatttcatcctcaacctcgaaccatgcgtagtagaccctcaaaaattcagtagatactgaataaatggataaaagataccttatctatctatctatctatctatctatctatctatctatctatccgtccatccatctgtcttaaaattaaaactaacaggggcactggagcacttctacctccttctcatcatttgtgtctagagctccttactgccacactgttgaagagatgagtggggtaatagaactggtatatagatgtatatatagatgtctgtgtaggtacatttgtacatatgtgtatatgtgtgcatacatatatatgcacatacacttaacacaatctgcatttgaattcattcatttcttcccaacctgtgttggctatgatcaccattactccaaacgcaggcagaatatgactgggctgtaaggtcccttcacaccacagtcagtgtcctgtggtgtgagaaagcataaagtgggcagtgcttgggacgaactgtccctacatcagggaggattcccagatctgttccctcataccatgtgaacaatgcagcaggctatacatcctctaaagagaattaaactgggtaacaggccaaaagcatcataaatgataaagtttaataacactatgaaatataaccatgatcagccaggtgcgatggctcacacctgtaatcccagcactttgggaggccgaggcaggcggatcatgaggtcaagaaatcgagaccatcctggccaacatggtgaaaccatgtttctactaaaaatacaaaaattagctgggtgtggtggcacgtgcctataggcccagctgcttgggaggctgaagcagagaattgcttgaacccaggaggtggaggttgcagtaagccaaggtcgtgccactgcactccagcctggcgacagagcgagactccatctcaaaataataataatacccatgatcagatatttaaaaaaaaatgaaacaaaacaaaaacacatcaaaaaaacttgtacaaactcagtgactactaaaactcatctctctctaactttctgggcatgtatctaaaaatcagatgaactcccttagtccactcttccaattcctttgcctaacttgactgtgggttgctataaatttttacaaccacagcatgtttgcgataaaggcttactttttctgactgaagaatcgcatgtttgcagttgactgaacatgcaccactgtttcacaaatgccacactctcaatccacctggccaatgctagaacacaagctgcagggatggcagggagaggctcatctaacacactctgccagcatcactgcgtgtataccagagaaagcatgtgtcatcccagacttggtatcccatgatccaggagatttacagttctctattcatgctgcaatggcataaactgcagaagatccctctttcctacttttgctaaggcaccaaaacctgtggaaatgtatctctttttcttattagcttgctaatttgttagcttggtaaacaacatcccaattgctatatatgtttctgcaggaattgcttcatcaagatgaagttggtaccagacttgtgaaaagatggtgctggggatggggacaggaatgcagcagctttcctaaagtgaaaaaatgacaggctgagctcaggattcagggtggtggaaggtgatgagagggagaaaattggctgccagggcagtgataaaacagagctgggagctggcagtgtctcctctggctgtgaaggatggtgctgatgcacttgacacagagatccggagcaagggagtacaacaaagagtagaaaccaggaaatcaaaacacattcaaggcagacagattccaaaggtatcatgcctctgtctatgctaagtgcatgctttattcattttttaaaatcctacacaaactgaaagagacatcacagtctactgagccgtggaattaggcaggacaggtgcttttatatgaatttgtattaaacctactgcttaaatgtaatccatggtggttactgttatcttcacttataatgaaggcatatcatagaaatctctgcacattctcacttagctctcctgatttcccgttctccttgggcccacgcttccactgagcaagtgcacttgatagtagtaatggcaagaaaagcagacaggctcatgtctttgatttataaacatgccgagtgtgtcattctctcctctccctggccctgaccagtttcacatgtcccctcatgatgggcaaggtagagtttattaaaaaaaggagtttttgaggccaggcgcagtggctcatgtctgtaatcctagcactttgggaggccgaggcaggcagatcacttgagttcaggagttcgagaccagcctggccaacatggtgaaaccctgcctctaccaataaatacaaaaattagccaggtgtggtgatacacgcctgtagtcccagcttctcgggaggctgagatgggagaatcgcttcaacctgggaggcggaggttgtagtgagccaaagtcgtgccactgcactccagcctgggtgaaagagtgagaccctgtctcaaaaaaaataaataaaataaaaattttaaaaataaaagttttggaaagtcaaggttaacagctgaatcagaatccttacctggtgatgagttatataagtgatgcctaaatgtccctgtgagtgtatgtccatgcagtcatggcattctaaaggttcatcttttttacttacaaaaaggcttcagcttacgtctatcattagttaagtttagaaagccttcagaaaggcctcacctgttcccactgggaatgcactgctgctctgatgcaatactacactttaggtaatgccacagccatgttactgacaatagcatatgacaaaaatgtctccccgctattttcattagccagattcactccacccatgacagatacccatgttctactaaacttcacaccagtgcattatcaggaggaccaatgtgcttccacttatgtattagaaagaaaagtggattatacttacaggaggccccaatacaattggctctgcttgcaaatactgtcccatggacaatggtgggttatggtataaagcccttctgggagatggcgctcttattgtggtcatgtatcttctctctcttctaggagagaggtctcttcttgctgtgatatctttcccaggagacactggcctccttggagacaaatgccttcttggtgaaacatctctttgggacatctctcttctcaatgcagcttcctttcttggtgaaagatgtctcatgggtgacagatctctcctaggtgataaatgtctcctgggagataaatctcctttgggtatcagatacctctttggtgaattatctcgacagggtgaagaatcatatcctggagaggaatggtggcttgagggtgagaagtccctgggagaggagcttggctctgaaggtagcatgcactcctcatccatacaactaggtatgtccaatctgtctttgtctggttctgagtccgtacttttgctctggaatagcctctggtattctgtcatctgggtatcttcacatgaatcactgggtgtcataagctgagtaactcgaatacttggcaaagtaaccaaatagctgatcaacgaagaatgtcccagggaactatctgaaggaaccccgtggggtacggcgccaacattcacaggcaaggaggagaatctaggaggctgaggactggtgcttcttgatcttgtttttggtgttaaatctccctggtcgtcaaagtcatcttcatcttcatcatcatcatcattatcatctccatcctcaccatctgattcctcagcatcggagaactgatgatcagttgaaatgctggacatgctatgcttctctgctgctttgtgcaaatcttccaaattttctgaaacaattaaacaaagataatggagatcaagatccaaatatcaaggttaggatcttatttaagcctcatttctttctaaacgcttttcccaatccctagtgcccacagatagttatgtctgagaactcctataaaatgaggcacttacctgtgtgaccctgcgttcattctatcttcttgtatatctatttgttttcatccccaacttacaagaaagattccatagtaggactttatatctcagacatcatcccactcacagaaaaccctcaacaaatgagcatggataatgttaattatgatgctagaggagaaagaaaggcaacaacctgtctctgcaagctcaggtacaaacgtatgtctaagtgatgtaactcaggaggtctggccaaccttaatgatgtttgtttgctagtttatttgttttcctactgggtttcttcttaacttgaataataatacattaaaatgcttttcaaattccccaaaaagcctcataaaatctaatttgctatcacaaagcaagtgcaattctattcccttcatagaaggctctaaatataagtattttcaaagtaaggccttttttgccctcggagtcaaaactgaaatgcatttcttctcagtagatttcaagcaattcaatgtgtcagttttattttctatatttagtatttaataaaatgaaaagtgatcactttttaaaaatatctaaacttattttactacctcagccacagagctccactgtgcataatgaagaggtctgtcaactcatttatgacatacacacctgcttcctcagtttctgtatcatccaccgatgtcattgagactcccaattccaggcattttttcatgtgtgctttagatttcatatgcttcgttaggtttccttgaaaatgtagcaaaaaaaagagagaaattaattggttatcaaattaataactgctgatagctgctccaaattcaatgtgaaatgaactaattttattaaattcatcatgtaacacagatttgtttctacccactaccccttgtttcaaccttaagaagaataatctggtctttgaagatatcaatccctgagagctttggcccaatctcagatattctttattctagaagatatgtggaagtccaggctcacatcttttcaagagtaggctcaaagcaagactagaaatcccaggcttttctgcctgagaagggacctcatatctacccaaatacaccagcctcctgggactccacagaaacaggaaacgcaatctggccacacacctcagagatacttcagaatgaaatattctcaacacacccactgggcccctgaccttctgtgactgatcaggtacagagtaacctccaaggatcttcaccattcagaagaaaaatacatacaaactaatgtgagggccaaccttgtcagtgctctgaaagatccatacaaataattagctaactactcatagggagcattattcccagtatttagcatctatctgtctggcatatgttagcaaaagttatgacagcaattcctaaaattctggagcagcaacattccctctttacttatcttcaggctcctatcacactaacaaaaaagaaaggtttcatgctgaatatgttataatgataatggcatatacaattatatgtgtatatacatgtgtggatataaattatatatataatttgtataactgctttatgaaatgtgagaaattttgaaaacattgttccaatcctcgttgacccaggatctacagaagaatgcacacacacacacacacacacacacacacacacacacacacatacatataaattatatgccatataacttatcaaaagagattcaggaactaattcagttgtaaggcgcctttacatcacttcagtgaaaatagccataatgttatctgtgcccttgacaacgctttagcaatgtaccaacaaatactttaagagaaggctctgtgaaatctccgtggaaactcagcctgctagcacagtttattcctctggtaggggtgttcagcttgctgttcatgtaatatatgagccacagttaaaactgggacactgttgtttattattttactcatattgctttattatttacttattgcttatatacttataaattttacatgctgttttgaataattccaaacagaaatatttccaggcccccactcctcctatttatcaaaacttatatctaccattttttaaagagcccaaaaatgttatagacatatcaagaatgcttaaatctagaaaattaatgaaatgtatctacaaattaataaaaatcatcacttgtgccagagtgcaagtacgctatggatgtgtataggtatagatgctaagcatatcgggatagtttatttagattttagtatgtgtttctttctcctacatttttctctccattccaaggatagtcaggctttagactcccatcttcagaataggtctgtagctagaaatctggatctgaaacaattctaccatggctttagtttgttaaagtcatgagctgcagaagtaatgtataaggacaaggagagggaaggagagtggcgggggaggcccctgaagaagtggcacagacaaggagaagggattggtcatgcaagggcgttccatctgtgctcagacgacaatgtgggtttggacaacaggcatttcagtcggaggtgaaaactggcagggtttcccaggatgttttgctcattttaagattctgagacatttgcacattcccaaagggtgacaaggaaactccaataatgaccaagaataaattatttccttcaggagatgatgattcagaggcagacttaatttgatttttaaaaatatctagagatgtgtcatttcttcatccagtttttcacacaactatacctgcagcaaactcatatgcccagtgaagatatgtatcattcgtaatgactattgaattgcaatattccctgaaaccaaagtttttattttcttatctcctagggaatctcttagtaaagttctgtataaaaggcttgattgtgcagaggtgagtggtatttaaaaggccatatgattattttttgagacacaaatgaacacatacttttttcagcttcaaatgaggcaattctattacatagatctttttaataaaagagaaacagatatgttgagaggctacccatttacacttctagcaatttaggattttcagctataaaagaatataggtatacatttctctaccaaagataattttacttggtatttctttttcttgaatgagcagattaatcaatatgaaaatttaaagtgttgagggggtgcctatagtatccactaaacctaaggtaaaacacacttctgcaaaagtcgaacaacctctaattcactactgtttgtattctgagactaccagacttatgaacattttcataatattataaaaaataaaaatataaccgaagcaacttccttgagtaaaatatttttacataaatctacctgttaaaaacagattttaaaaaaaaattttaaggcaagtcctagttttataagactaacagttatgtactgagaatcagaaattgtctctgtgctgataaaaacagggaacacaagctatcaaatttctatgcataattaatgcaactgtggatgaaggcacccacctgggagtgtgtgggtctctacattatttataatcttgaaactgaccaagagcacatgttttcttcccagctgctgccttgcttctctaataccactgcatgtgcaggatttcaatactggtgtaaatattatctagaccacataacatttccaacatgaagtaatagctatccagacaatttgtagccacttcctttggagacaactggcctggacctatgtctactgctcttaattaagtcataaaaggagcctcacagtctcacatacatcctttgatcacttacttgagggagaaaatatatttcgtggaatcatattttcacaaacaaactatctttattgttgatgaaggttagttataaaatagcactcagaaatctaagtagccatagagaagtatttttcctctcaaaaaaatcagacttgtacctttcgttttgaaggcaaagttacataacttgcatacataaggccgaacatcagtatgggtacggatgtgttttttgagcatgcttggcttcttacagcgaatcccacattcttcacaaatgtactttccccggccacgtcctctgacatatacataatcttcattcgatttgtacctgttttaaaaagagggaatccagtgtgttttcaaatattcttagcatgctatatattaaagcaaaagctaattatttgcacggcaaagttttatgagggtcttttgcagacaattattcaactttacttctacgaagcctgtgaaatttatgcagtaaatggctgaaagaactagataatagatttggcactgtaaacaaaatgtaatgctccatggaattcaaaatggaattggcttcactattacatgtgaatttatagagttgggaagtagatgttcaaaatgacttatgtaaacctcaaagagctgcagacctttggactggattctagtatggcctccaatcaagggacatacaaaaagcataccaacatgttcatcatgtatcttttgttaacattacatcatctaagatgtacatgtacaaacatacaaccctctaaatttgctaaattaagtataactgataatagaattcttcattgcaagttcctactctatttttacaatcctggcacgagagtgcctcagaaatttctagtttacacagggtgagctcagctcaccaactgttgtctacagatttgatctgctcttcccaaagaccatgaatctgtaataatgtggagtctaaatttcaactagcttcttcaaggtagttacataatgaaaactagagattctatttttaatcaaatttgcatttgtttccagaagggtttcatagagatgtttgaaaggatatctgaggtcatcttgcttaatcaaatcggctagaaaaacagtcttaggtattttctttgataatcaagggaagaaatctacccaatgctcaaccattccattttagaatacaataaaacataatttgtcataagatatagtagtagtatacggactaattcaatgactgtcattatctcttaagtcaaagctaggctagaattttgggtctaatgttatttttggaaagacgctccatttggggagttcttttcataacttccaaaggtaaactgacatgcaaaatgccctaatccactgtggatttagttaaaggcactaaatttacagtttttttacattctaagagcattgcaaacttcctcattttatcctagctaatccacaaacaggaataaaggcaagtttaacttcagtcatccaatctattgaaataattttaagaaaggaaatccatccacatatttaaacagcaactctgttacggattcacatctaatcttaacgttatctactttttggtcagtaccaatccagatgagagttaagtagaaactattcaaaactatgaataatcaattttgcatgtcttccgttcctttaaatttccccccttttaccaggaattttgacttccacttgttcttcaaaattattttgaattttatctttgtcttttgcaataaagtagaaaaaaccctaaagatgcaaatgtctttcacctttaaatttcactattctctgcccctaactagatgaaattgcttaagacatatagactaaaacaaatacttttgtacaaagctaattttcttcaaggaaggatacttcaagcttactatagcctgccatcatagtgatgggaaatgcattttatcatcaagcagtataattttattttcaatgtcttagctgattaacttgcttccagaatgaaaatacagtaaaattctgtataaaatataatgatgtattagagaaactggtataaataatatatcatacaacagttctacaggcccatgaatctacttgataaggtaattgatggattttgaaaaacattcaaagctgtgtttaactaaattattgaatttattattaaacctatcagttagacaatatacacttacaattttggtcagtaatactttttatttttttagctatcactttgcaattgccaaaataagaggaggtaacacaaggtttggaaaaaacacttggtcaccactgggcagaaattgggccacagattaagaagtaatgggacacagcccataaaacggggcaattaaaggaggaggaaatgaaatatgggcacaatccttttggatcaccaaaacacagcaataaaatgttcacatacgctttttcacttgtgtccttcgttagtggagatgggctccccaaagcatacagtaattgtggagttctcgctaatctattggtgcaagtacactgctatgaaggctgctgaatgtgagagggttgattcagtcacagggacctctcagtctctgaggagagataaaatctatatttctctcgtttgtgttaaaagatgggggatgtcaaaaaaatatcaagacaagcttcatgactacatacaattgtggttttagtggtgaaaatgctagatatccaaagagggcaaaacctaagggacaaccaaatagaataatccatctccaaaccggtaatgctaggtgagaaatggatatttcatctcactgaacattccacattttatagtcaaacaagtaacattatttcctccaaatataattggaataaagtcatgcccatgaagatatgtaaataatagatttgttgtagagataaggctaattacatcataatctccaaaatgtggttagcacgcttcaaaatttttaaattttagaagcataagtgtaggcttttccttctatgtgactggatgaaagatacatttctatcaaaatctaaaacaagacattacatatgtgtaatttttcttaactatacaaataacaaagtctttgaaccttattacttgagtttctatgactcaggactcaagatttgaaaagaaattcctaaatacagagaaagtgtcatacaccagagaagactgaaaaggcaagacaactgagtgcaatgtggtaccctgacttggatcctgggacagaaaaggatattgatggaactggtgaaatcccattaaagcctctagtttagataataagaaaaacaaacaaacaaattaactagttctgaagattatacatgattgtgcatgatctgatttttgtaagcatacaataaaaatatgtccgtcaataaaacaaatacctataaaatgatcaaagaatgaacaaacttagatgacatcaagtgtccaccaatttagtagatttcataataaattagaggggtgaaaatttaaggaagaggcttgaatgatatccattagggacattttcttgcaaagcaaatcccaaaggcaagggcatgaacttatgatctattaccagccagagttcagaactgtgaatagaaaaggaatttactttcagctttcaaccagattagacagtaccttttccatgcagacattctggaccatttactctgacctataactgcacattttacatttgcactttgtttccttaccctccttcaaatattttaattcggattggctcagtttgtttggatccaatatctttatctccatgaatatctcctttccctctttcctttaagatatttcccactagtttcctttctagtttgctgccaaataaaaaggacgcatcaggtttcatctgtaagacaagaagagagaatcatttcacatgctttctccaagacacaggagcccctatgtcccactcttccatcatctctgaaaatgagcctaaattctgtactaaaaggccaggaactagttatataaaataaggaccactagggataaaatcagataagaatgacagtttccactgaataaattcaacattctgttacagctatatataataagtacatatattatatataaaaatatatagatacacatatacactcagcactctgtgcaatgctaatacttaaaagacacattctatgttttgaagtagcaatgaaaacaatctatattaattaaggaagtagtctcaaaaattattgaagggaaaatggtaactgataaaagtgaaaacatatttttaaatcctctatttgcctccttattaatttagcagaaatttcaaaattccccttaatatttttataattttacatggaaggcattgatggttcttgtaggaataaaccagccagcaacttggaaaaataagttttgaaggagacagatgtctcgtcaatgagagtaagccctgcagcatttgcaaagctcggtcctccttcttcgtctttcctttcagcctccattccctgctctatggcccacttcacaattccctgaattcctcacatccagagaaaattagacctgctaggtcactcacaaaggtcagaaggaaaataacccatgggaattaatcccagtggtaggatttcatggcacccaaatttttaaattttaaaagcataaatgtaggctttttcttctgaaaatggaccatgcctgagacctcagaaccaagtgcagtcagtggcttcttccactcctgagtaaggccagactttctgaaaacgcccccacactgaccttcattttacttgtattttttttttaggccttatatccttcactatgtagtctgctcagcaatcaaatccacaatacaaagttcttcctaaaacagtatttgttacctgagtaaactgcttccaagcacttgatgatgtaagcttgccggttccaggcctatgcatagcagccagagtataaatttctgcagtgattttttgcttggacctcagaagagccagcgtggtcttggtgttcaatcctgatgggtttggattacaggaactaatgcaccatgaagcataaaccgaggatttgaaggtggcctgttgcacataattgggttttgtataattcaagaagcaccaactcacagtagttgttgtccgcagactggggaactgaagaatctgctggaaatctgccatgtccgtgagaagaagagttgagtctgccacgttcccgctgggggcagaggccatgcggaccagcatgccaacaggccgcttgtggcccttcccttcctcttccagctgaccatctcctgctggtaatgaagaactctgtgggctcatgctcatgtccgatgccgtctcatcgatatctaattcatctgaagattctttgctttcagaaggcccactggacttctgccccggaagtggtgcccgggaaccggaaagcatctccttgctgggcaggaatggctccctggaagacgggctaacagaaggatagtcttgagatgaggagggcgacagcgaggagaaggaagatgaccctgactgcaagccatcttttggctcagaagcacatccttgtcgaaccagctggggtttctgggggcgggagaggtcctttttgatgtctgagttggtcagctccacagcactaagctcctccacaatctgtccgtacatcttttcttctttgacccttttctgctgcttggtttccatgaagagctccaagctactggctggagaaagcattcgcttgctacctcccagggtggccacgctgtcagaggtggaaggtaaacacaaggggatggaggattctaagccgaggggcaaagtctgaggtgctttccaaatggggtacttctccaagcccgcatgctgccccagcacctgggcaatgttgaatcctatcccttgcatggctgcgttggtgaccagtgtcctttgggtcatattctcatcgactttgcatatgacaatggcagggctattctgcccaagtatctgagaaatgcttgtgtacatgacacttccataggatggtacgtgcgtctggatccgaacaggaaccactgttcctgggagggactgcaaagacccagcatttgccgaggcaaaatcttcttgaagaacctgctcagagggcgtttcagttgacttactgctctggtctgatggaaactttggaagaaggttctttgggtgtagccctgatgctcctgaataacatgggtaggtctgctctttcgtgtgtgcatactcagcaggtttctttccagtgtgctctgccacatgctctaagggatagctcgaatggatttctgtctgaaaagagggcttgccatagctcttctgagggtgctgagcaaagggatgtgggaaatgtgcctgccaccagggaggctgctgagctggtaaatgaaccatacaaactgtaggatactgaaactgaaacaaggcattctggattggagaaaatggaattgtctcttgatgtggaaataagtgtggctgttcaggtaagtgcttgcttgtcatataggatgttggttggatcaagggatttctcaaagattcctgactgtccatgtgcatgatctgtggctgggccaggtgcagtggccccgagctcagcgggggacaaggacccgccacctgcttccctgggtcctcttgctgaagaggaggcagcacagcaggcgggccatggtgccacccggaccggaggccagcatgcaggtgctccagctgctcttgcttcacgctctgatccatgccaacctcgccctgggagatttctggggagccactgaaggaagcttgccgcaccagaaagcatttcttcctctccctggacggtgataccgtggaggctgctgctcccgacacaggagcatgggacagattcccataatcaaatgatttgctccgaacttctgggacttccgctgggtgaggacaaggcatctgctctgatgagcagcgtcgcatctctttctggtggtgatggcctgggacagacaatgagtatgaaccagcagggacagtcagaaactctgaatgcttcccaaactcatcctgcttaggaagtgcagaaagcttactggtttcttctctttcaaaagacatggagaaactggagctgtgggacaagttgctttcttggctggggctgcgggagaggcctgtgcctgtggattcaaagctggactcccctgaggagtgctccatatctgcaagtcgcagacgcttctttttgggtggcaacttctccgcggggagctgggaaagggtctcacttctctggggccactgaaattcttccacaggcttctctggctctttgctctgggcttccttctccttctcaggtttatcaggctcctcggtcactcgaatctcaggaacctggatgttgtgttgccgaactagcctgggctgtgtgtgataggactgctgctgcacctgctgagatggagagggtttccccccactttctgcaccatccccaggtggagcccactcaggactcactggggcttctgaaatctcactgtcacaagtctctgaaggggaaggggctttatcctgtgtgcaagccacaagttcggctgactcagacctttcaaatgaattgggtcggctcagtgagttggtgtgctgaatcacagaaatcacatttccaggaggtttcctgccccctaggtctgacatcttgtctgaatcaatggctgaaggtgactcctctgacacaagagatggacttccaggctgcagttggggccgacatgggtcaaagcgttccgtgtgaccatgagaaaggttttcgtgtccagccatggcaaatccactcctgactccttcctgcatctgcagtttggggtcataatcggaagccatgatgcccacaggagtgcttacaatgctgctgcagatcatgggcgtgtcctcttcatcccctacgctcttctctttccggcgtttcctgttttcacaggtagttccaaacatgcttggtactccctgcaatggcaccacgggatccatgaaatattctccaccatgctttaaagaactcaagcaggaaatgtccctgtagttttgctttggtgtttcagagtcctcccacttcttatagggtttccgacagacatcatagtcatacccaaccctgtccccaggagacaatttcttttccttcagggatgaactgctgatacccttcaacatcctgccatggtgctcgacttccacgtggccctcctgtaccgaaggcagctcaaatgccgcttgtcttcttagcatgcgctgagggggtatgcccacggtccctggatagaatacatcgtcggaaccagtcatcctttcatcaaatgagtgacttcctctcaaagaaggaggaatagttagattagttgctgaagaagttggcactgagttgcttctaataaggggtgaagagtctacaggagcttctaagagaaccgggttgctgccttggaagtttgctggataaagttttccttcgttcctgatagatgatggaataatctggggttgtctggactcactgttgaacttagtggatttcagcatgctcgtttgactggggtcgacatctcccttgcttgggatcagctgtgaaacaggatcttcaaacatcttgacatctaacctggtgttaacgtgaggtaatggttccattatgcccttcctacccattgcggcacgctcctgacttgtggttgtaacactgagtgcatttctcggactaagccgacagtattttccaaagatgatttcttcataagactttgcatttgtgttgggagggcttatttgctgctcagcactttctgagcgagaaaagtaaccagaatcagtgcttcctttactgtgcgggctcagaaggttgagcgatggctcagaatcttgtccttttttctctgacagtcttagtgcaagtttctgtttgactgtgtgcgaatcatcagccttagtatttaaagatggatttggtagcatatcagggccaatatactgagagctttcattagggagaggaatcccacttttagggataatcaaaatcggcaccttcattggacctcccaatgattcttccaatgacccatgatagccgcctctgctggcaatgtccagtgggatgggtggaccaggactcattttgtcagaagcctcggcaaataaagaactctcctcatctgtgtctgtactctgttcaccatctgaatgtatttctgcttctacatcaataaaaccagcctctaggtccaatttagatacagctgactctgtgaaaggtactaatcctgccttaattgcatgggcatgtgacttcctgtgcttgtacaaattgctctttgtcttgaaagagaaaccacaaggtatacatggatatggccgctccccagtatgggacctgatgtgttttttcagtacactaggtttggcacacgctctgctgcagtaagggcaaatgtacttgccaggctttttgggtttgtgctctttcttgtgagcctcttctgcctgttcaatacttttctgggagtattggctataagcagggttcagacttgaaatcttttttctaggataaccaccactgtggccatgtataggaaaaggaaataagtcctcagaggcaacggatggcaaagggccagggaaaagccacggaggaccttcgaggctctgatgtggcttggtgctgtgcatgaccccctgtggcaatgagtgctgagggaaagagagtgagtgttggcatgagtaaggactcggacgatgcggtggatattgcttctctgcgacttgctgcaccacttcactaggggaggccagtttcccagaaccaaacagttgtgctgatgctgtgtttccgatttgctcaggctctatttgtggttgccgctgtccttcatgactgccaaaagtgctcatcttaataacagctgattgttcctgtctccatctacctgatgctttatcagtttctccagaccttgaggtagctttttgtcctagagctgtgtccccagtgtccattttgttacacaaggtcttaagtgctagttcccctgaaagcagtgcagactcatggagtgtctccaaagctgtgcttcttaaagcttggttgcttccatgttccagggtgtctgcaaacttgctgattgctccttctctttggaaccttccacacgcacaccacagtcgatgggcattagctagtaatgtccttggaccagggctataacacagttctctccattgtagaaacgtccatccaaaagctaagtgcaaatctataaagatttcttatggcatttgaaaattttcaactaggatgaaattgggatgatgaatagtctaggagaaattttgcccatcaactagagcaaagttcaattgccagtttcactaagataaaatgatctgaagaaaaagaaaatacaaagagattgtcataacagtttcaaataagaaaccaaaaaaaaaaaaaacctaactaaccaaccagaaattagataaatttgaaatgttttttactccaaggaattatttttattgagattacattaattccacaattaaaatatattaatttcaaactcagcattaagtcatgaacataagtctcttccatgtttgaattttggtcactcttttaaatactttttaactttagaaaaccatttgaaggaaaatccttgatggatattatctacaaaagtataaggttttagaaagccccattaaaaaaaaatagagctattcctaaccaagttttatgacttgtatgccaaagtgtattacatatctctatatagagatatgttttatagcttaatacaaacaatatgtggccaggcatggtggctcacgcctgtaaacccagcatttggggaggctgaggcaggtggatcacgaggtcaagagactgaaaccatcctggccaaaatggtgaaaccccgtctctactaaaaatacaaaaattagctgggtgtggtggcatgcacctgtagtcccagctactcgggaggctaagggaggggaattgcttgaacccgggaggcagaggttgcagtgagctgacatcatgtcactgcactgcagcctggcgacagagcgagactccatctcaaaaaaaaaccatatatatagttacatattaatataaaatataaatataacatagtatacatataagcatacatatatgatacatgttttataaaatacataattcataaagtattatatattactataaagtataactatattttacagcttaaaatcagtgattaataaaatgacatcaaggctataagaattagatgtcacagaactttggaaaagataaaagggtgcatctaaacaaaacaattataaagtcttcttaatatagaaaacaaagcatatttctaggacagtttaaaaacgaaatgattacctgaacagtttagagttcttatgggcatgattgtcctgacgcttcctggatacaaaataaatgcagttagggaaaattgttccattaaaccttaccatcgatatatacaaatacaaattccaatttccagttcattatataaagggttcacaatgctatgtaccctaaaacgaaagcaagaaactgcttcagaaagcattacaccagaagagtaaaccttacactgacactgtgactcaaaaataactcagagaaaatattataaaaacatcatagtaatattttctaagacataagattattatatatgaaacatcttagttacttaaatgtaatcagcctagttctaattccctagatattaaaagttgagatacaggcgttttttgttttgttttttttgagatagagtctcactctggtgcccaggctggagtacagtggtgcaatcactgctcactgcagcctcgacctccctgagctcaggcgatcctcccacctcaggctcccaagtaactgggactaaaggcatgcaccactacatccatctaatttttgtattttgttgtagagatgagctcttgccatattgcccaggctggtctcaaactcctgggctcaagcaatctgcccatcttggcctcccaaagcgttaggattataggtgtgagccacctcgcctggatgaaaatagtgggtttttttttctgataggtttgaatgtttatgtttaaaagaataaatttcccttttaggaaatttacatcatagcaaagtgaaggagtcctctagatgatggcgtatggctcaggaagacttgacaactaagtaatcgttcaattttaagtgaatactcaacttccttaggggagtgttcaatgaggtacccagaggattctgagaacttcaatgataaactgtatccactgtcatagaacctcagatgtttccttgataggcaatgtgtccgtttatcaaaataaaaaagatcatacacattgacctagaaattccactgctggaaatatatccttacaggtgtacttgcacaagcgcacaccaatatatatgtacaagaaccgcttaaataaattatggctcaatgataaaactgaggcatttaaaataaataaagtacagctataagtaccaatatagaaacttgttcaggggatagtaacattaaatgcaagaaaagcttattgcaccctagtacgaagacacattgttaatcctatgggtgaaaaagaggaacagttgatcaacagaaaattcctgtgaggatgccaggcagcattggcaccagcctgaccaacatagagaaaccctgtttctactaaaaatataaaaaattagccaggcgtggtggtgcatgcctgtaatcccagctacttgggaggctgaggcaggagaattgtttggacccgggaggcagaggttgcagtgagccaagatcgagccattgcattccagcctgggcaacaagagcaaaactccatctcaaaaaaaaaaaaaaaaaaaaaaaaaaaaaaaaaaaaaaaagtggaacctgggattcagaggaagaggaaagaaaggatttttaccttccatctcatgactttcagtaagtttaatttttgtttatttttcttaacatgagcatgtttatctttttaaataaaacactagttaataattttttaaaatgctaccatgcagatgtactgcagattcctaaagcgaaactcaaatagtagtcttacttccatgggcaattttctccctaacatcgaatttgactgtgatgatgatgatgacagaagttgcactttgagaggggaaaagcacccggaaattcccacaggaacggtaagtcttttgggtgagaaatcagtagcccccagatatttgtagtaagacatctgtactcaaagattccttctgttaatggccatgaagcctaagagatttgtaaagcagcagtcaaaatactaaacaaagatattaatctcagtttgctaaaaagttttgctattggatttaattttttgctgtgcaataattttctttagcatccctctgcaggaaatgaggcaaaaacgaaacacaaatgatagtctcataatattccaatgcaaatttccttgtgtcaattccaggaaccatgctaacaagaagaagacacaatgttgaatctaaattggctgactgtgtttaattaactaaatatttaaggttcatgtagacacaacctctgccagacttgtagaggtaaataaataccctctaaaatggaaatatactacattttcaattcaagacaagcatgtatgaatcctcaattaggactcagagcttgaagtgaataatttctaagttatttttcagatttaatattttatcatggtattgatctatgtatgcagtttcattgttaattataacaatgataatgactgtcatttactatatatttaccatgggctgatacatactgttaaagagtttcatatacattgtcttattttatcttcattatacctctatgctaagggtattattacacctattttacagttgagaatgattcttagagaggttgggtttcagaatcaaaattcagatctaaatttggtgacttctaagtctgggaggactcaccactactctccattaagttttattacaacttaaaataatacatcttcaataatatcttcatctaaatatttccacttaactttaatatatgaaatgtctcaacttttaatggttctgagagaatataaatgagctctgcatgtttgtagtacaaaaaatggccccaaaatgccatttcctagaaataaaaaaatccataatttaaataatgttcaaaatatgtatattaagtattaatgagaacagcttcttgtaagaccataataaagtctcatgccagactgttttcttttgttctttgaaaatcattacttttatttttagaggaggggggtctcactttcttgtccaggctggactcaaactcatgggctcaagggatcctctgggccctgcttcccaagtagctcctaagccactgtgcccagcttggaaatcattagttttaaggaaaataagaaccttacaagtgaaaatcaggtatgtatcattttctatcttttggttgacacagaatatataattttgctcaaaacataaacttcaggggctgggcatggtggctcatgcctgtaatcctagcactttgagaggtggaggcaggtggatcgcttgagcttaggagttcgagaccagcccaggcaacatggcaaaacaccgtctctacaaaaaatacaaaaattagctgggtatggtggcgtgtacctgtagtctcagctgctcaggaggctgaggtgggagaatcacctgagcccagcaggtcgaggctgcagtgagctatgattgcagcactgcactccagcctggggaaaagagtgagactatctcaaaacaaacaaacaaacaaaacaaaaaacagcataaacttcaagtaataagtacatacaattttataaaaaacagggttggaataatttatttcataagttattcaataaaatataatgttttcacttagcaatgaggtaatacctttataaatcagacatttaatttttatggtataaaataataaaaccattcttatacactaagggcatatcatatagtaaatgcatcaaataaaattcagaaataatattttgctaccagagaatacaccagaagttgaaaaaaagtgacttacacaaaattcaaaaccagatacctcatggtcagaacaaaacatgtctagaccattaagttaattgtttaatttttaggagaaggaggataatcagaaaaaaagtcttatctatcactttattttaaaaaataattttgctaagtttaacataggatctttctatattccaacagcatttattatccagaaagtttttaagattcaaaacattaactcaattatgcaaatagcttctgtcaagaaaatctcttccttttaaatttctaagacaagcctacccgagatgccccaccattttaccaggaagctaggtgatatcccacgccatgctttctctcctgggttgtgcgggaagagcttccatctttgtgcctaagctggaggtcccagcactacagggacccctcctctgatccacaatgtctagtttttcacttcagtgaaaggcttattagggaactagaaatcatgcttatttcacatgaactttcacatttgatttgaaacatgtttgaggatgtctttttctctccaacactatccttggggagcctttgactaactgctatccataaaatcacgtctcttcttggagtttctgagacatataaagaaaggtaggtgggagagaaagtgagcgatggcttcttttagaatttattgatcatatttatgaaccattaaaaatatggactatttgtatttgtcacttttctacagctgctttatcctggaaactgaaaagattctgcaatggaaattgtgtgcatcataatctattactgaacatggcatgactttctctttaaaaacaagcaggatttgggagggtttgaaagtttctctgctactccactcatgttatactgaggaaaataaattcactttaaaaacaatagggttttcaagattagataatggcatttgtcttgttttgttaggtgacacttttactaagcaacttaactcttccaaatggcataaattcttgagcttacattttattactaaaatgtataaaaatgcttatagataacaaaacatttttaaaagtatgttagataaggaaatctacattaaatgaatcattaagtcaggaaaatactttctttggacttcataacattattacaagtcattaaatgtaccattgtatctacctgcaattttagtttaatttctgcaacagagatccacttagaactataaagatctatagtaatatggttaattatagctacagtatttctctatgactgtgtagagtcaattcatttttcagattctctaatatttcattaaaatatataccaggtttcctaatcaattgatatatcaaaaaatgcagtatgagagtaattctcatatgaaaacagcgagtcgtcactttattcactgagatttccttttatggtaaccaaacccacacaaagtcatttttggcacccactgccaacaaaggagcggaattccaaatacagttttgcattcacagttaaaattttctctagtgggttttaagtgctatgaaaggagtaagataatttactggagaataaaactcaggggatatgactttgggtttcctgtggatgctgctacagcccacaggagtcctctagtcagtaaagacagacattgtctggcaggctcatcacacttttcagagggggatcatgttaaaaaagagattacctctgcatggctatttcagtggtaatggaactaaaggaactgaagcgaaagaaaatgatattacagggaagagcaggcattcttctagaagtgtgccctctcctttggccactcttcagagtcccactcaaataagtttggcacccagttaaataatttccccagacagggtcccaaaggaaagacacataaacagcctcctagatggacctcctcagaggtctcttcaggataacggctgggtgggattggcaggaagacaggcttactctgcagaggaataaagacctacagtacccagggttgtcaatctgggatcttttgcttaggaaaacattatctcagaaaaaaaccttacctcaggaaattaatcattacttgagtggtggcaaaagtcaagtgagcattaaataatgacatcctaaataatgacggtatacaatgactggcagcaaacacggcttctccacttccaacattttaataataaaacatttttaaaaatgtaaatggtcacttggtcttttcttgaggatttggtggtatgacacttctaaacatttcgtcttttgttgaggatttgtggtttgacacttgtaaacaaaatacgtgtcttatggtaataattagtgaatgacattttagaagggacatcattgtatttgttattaaagtgccacagatcagttgtaaaatctttaaaaaatacatgaacatctcggggcattgtagttgtaacattgatcccacgagtcacttagacactcattgcccaaccaccgctcagagcatatatgctcagagagtatgggatgaggggaaaaaggaactaccaagaaagaaggcgtgatgagtgccagagtccagctgaataaagacttatttccacaggatgatttttaaaaaggtggcttcctgagagccaaattcattataaaggcttcttttagtaaaaattcccataacaacctcagttctctccaaaatgagcaagttgtctatatggagaaaactctattatatacaatcctgccaagcaattcagaaaacttttggagaaaagtaaaaatactgtgatgatcatcctctaatttgatgtaattaaaatctaatttgatatttaaagcctaatgagaaacaaacatattttttcacatgggctgcaatgcaggcatcattgcatatatttgtagagtttgcctatttagtcaagatatttatgacttattttggctacagcatgctgcttttaatattttgtcataccttttaaaataattttttaaattgtgatttcacttttctactgagatgttttctcattatacagcaaaagttattaggattcactaagtagagtctaacatgaaaataaactttgtcagaaataaattctgtcgaataatgctattttaattataacaatgataattaattataattaagattggtgggctgggtgcagtggctcacgcctgtaatcccagcactttgggaggccgaggtcaagagatcgagaccatcctggccaacatggtgaaaccctgtctctactaaaaatacaaaaattagccgggcatggtggcaggtgcctgtagtcccagctacttgggaggctgaggcagaagaatcacttgaactcgggaggcagaggttgcagtgagccaagattgtgccactgcactccagcctagcgacagagcaagactccgtcacaaaaaaaaaaaaaaaaaaaaaaaaagactagtctactatgaaaaacaaaatacaacaaaacaacacttttctctctagatggaaaatatattgtttcctccctccagtttatatatgagtccatagtaggccaaaacagcttttcaagtttaatgtaacaagagagtaagaataaataaattttagttattaacctgttatcctcatatcaaaaaactgcatcacaaccgtctttgatttccaagatgccaactctcctcacaggaactcatgcacaacttctgggaatctaaaagatgaataagaagatttaaaagatgatgacatctgtaatgaatttaataagcacgctcattcttcttcactcacagaacctgccttcctttaggaaagaaaatttggaactggatctctcaagaagctttttttttttgcccccaggaaagaatttcctttcttttaacatagtttaaatcttttgaataaatacttgtaattaaagggaattccctgtaacagtgaaatgctagagttaaaacttcaagtaccagcactagaaattgtgtcattgtagtccatgatacggttctgccacaaagctgagatttctacagaacttctttgggtgtattagcaactaaacctcgcaggatgaagtctcagataaccttgttgtaaatttgtttctatagtttatttcagcaatgttatactttgtgctaaaattaaattctgaaataggaatccaaacccaaccaaagcaaaattcagactttaaaagtctagtaagtaatgaagaaaggaacttttcatatatggaattaatatttattcaagtatgatccaaagaaatgcatggaagatcaaactacctaatctgaatagattaatcaacaatcttaacagagtttatctcccagtataaaagacctacttaaaaataatattataatacccataatcgtatatttgttatttttttaaaaaaatcgcccttttgtcctgacaagttattacaaaactcccataagaataactaaagcattaaaacataacagttaaagtgtgctttcctgcagtaccacttcatgtgaacattcaaagtgcttaaaggaagtagtttgcttcagtttccccctcctttctgcacaccactgcagtagcacttcaggacaccctgtgcacttgagacatgaatcattataagcaagtaggcccactcggttcctcaaaagacacaaaaggtgcaaaaatagcttctgcaattgaagcaagaaccacgtcagtaaccagatgaatgtgggtggtcacataagattctggtgctgcaaagggcaaattattaagcaaatgctagatttattttcttttttaaactttattcttcttgcctcaaatcaaccgtttgctggcactcaaagtgacacctgacaaggtctactattctcaaaattgaaactttcatcaatgctaaagagcatgattcattaacatagaaggaatagagatgatatcctaaaaaatatacattttctataagataattaactatatctctatctatctatctattttttttgagacggagtcttgctcagtcacccaggctggagtgcagtggcgcgatctcggctcactgcaagctctgcctcccgggttcacgccattctcctgcctcagcctcccaagtagctgggactacaggcacccaccaccacgcccagctaatttttttgcatttttagtagagatgggggtttcaccatgttagccaggatggtctcgatctcctgacctcgtgatccacctgccttggcctcccaaagtgccgggattacaggcgtgagccaccgtgcccggccaactatatctatatttttaacacactaaatatcacatctgttttaaaaaatcaaataaaagcacttcaaaaaaaacccacaaaaactataatctaggctaaagtaaagcatggcattcctcaaaaaaaaaaaaaaaaaaaaaaaaaaaaaaaaaaaaagaagaagaagaaatcactgagttattttgtactccaagcaaaatgcatccaagacataaatgggccaaggttctaaagatgcagatatttatacggaaccttaacttgcagtagtcagtgactacctgtgactggtaatctcacagtcaccaaattaagaggcaagaaggtaaaagaagagcttaattttcagtaggccagcaccaacctcccttcccttccagaaatcatcattcctaccagcagtctccacaggcaaaacagagcacgtgagtgccccccaacaagctctgatgggacagcattcccagttctgactccgtttttccagtcttactttctaagatgatggctactggaaatggtaaacactcctttcatgacatgcacatgtatttgaaattgtagattacagaagagccccctttttacccggtaagaggattcaaaaactggttctgttgcatcactcatgaccttttaaatgtttgggtttctcttgaagaagagaaaagcaatggtaatcatgttatacttatccttaccttaaagaaagttccagatgagcatgattttaaagcaaagatgcaaataatattagcatgaaagatatgatatcaattgcagcgtttttgcacaaatcattttgttataaattgaaatcagtaatggcctctacatgggacttggttattgttcttattgaaatggagatatggagatgccatctcagaaatttattttttgcattaattttaagtgagtttttgtgtctttatttctccatcaaaataaaagaaaatcctttcatcaaacagctcttgagaatgtactatgacaactcatgctcttattctcaagaaatcaacagtttacatagtatgctattaaagaaatggactaaaggaggaaagatgattatttctttaactttgcttttaggttattagcttcataagaacttaacaggcaatgaaaccttaatatttaataaaacaaacaagttttcagaaatagtgctaatgaatcttgataaaaatccaaaggtcatttaaaattccttcctaaatatgaggtaaaaattatatttcacttcaccacatacaagatggtttttctgtcaacctgcaggttaatggaagagacccttgaaaatattttccaatcctccatctcctatttgtaataaacacttggaagatttgagtattactgtttctatcccagtggtttctcagccttcccattcttagaagaaaaaaaatccttggcattagttacttgttgttggatgcttataggttattactattaagctaagcaagagtcaagctactgattcatagatgacagataagatagacattttaaaaatacccattgttagtggggttgtctttttccattctctacttttccaaattgtttcaaaacaagttacagttaatgctttaatatgactcttacatgaatctagcaagaggtgaaggtttcattggcagaactctcaagtacctcccatcacccttgttttttctgaggttaaataaatacacactatatcacaattttaggagaagagctgataaggtaaaccagttacactttagatgagcattgtcataattaaaaacaataattattggctggatgtagtggctcacacctgtaatcccagcactttgggaggattgcttaagaccaggaggttgagaccagtctgggcaacaaagcaagaccctatctctataaaaaaaaatttaagcaggtgtggtggtgcacatctgtagtcccagctgcttgggaggctgaggtaagaagatcatttgaacccaggagtttggcgctgcagtgagctataattgcaccagtctgggggatagagtgagaccccgtctcaaaaataaataaataaataaataaaaacaacatcaatgaaaataattcttataaactcaatggaaaaatggcaaatagaaactggaaacaagatatgatagttttatttctcagtaaaaagagtgtttaagtattacatgtttaaaagaatgaacactactcttcactagagaagagacactttactcttatagtagggaatagaaaagattcaaaagtagtgactaaagatgggagaagagcactgaaagagatatcaatgttcaagatataatccatcaatttcacaagctttttgtagaggcatcttttcctctctacaaaaaaaaaaaaaaaaagactctaaatgggcccattgttccactctggagtgcgtaaagtggcaaaggaagaagaggctgcgaaggactagagaaggcaggtacaggatagacaacacacatacacacacacacatacattgacaggatgatgactataagcttagatcttcagaaatatttttgatataaaggtaatggatgaggttggggttgaaatgtaaaaaagaaaacatattaaagggacatgactaggaaaagagaaacatagtagttttggaacatggggcaattcattactgggacaacaatgtagaaggttttgaaaagtcaagaaggtgcatggaaggaaggattcccacagagttttcataataggaggctggggcaaactgagtccaaattagccagaaactgcccataaaaatgacaccaaagctacatatggtctattgctgattctcagcaggtagtgcaggagcacagaaaagataggaaacaaagcattgtgtaaattaaaactagtgaaaacaaacaaaaaaagcagatacatgtgcattagagattgtaacttaggcctctttaaataggatttctgattattctatgatactttaagacatttacttatacctaatgttaaatgacgagttaatgggtgcagcacaccaatatggcacatgtatacatatgtaacaaacctgcacattgtgcacatgtaccctaaaacttaaagtataataaaaaaaaatccccccctcaaaaaaaagacatttactgaatgcctacgatatgccagaaatgggctgtatttacacaatacagaaaaagaaaagacaagcattgcatttaagagcacagagctggctgggtatggtggctcacacctgtaatcccagcactttgggaggcccaggcgggcagctcacttgaggtcacgacttcaagaccagcctagccaacatggtgaaaccctgtttctactaaaaatacaaaaattagccgggtgtggtggctggaacctgtaatcccaactactcaggaggctgaggcaggaaaatctcttgaacccgggaagcagaggttgcagtgagccaagatcacaccactgcactccagtctgggtaacagagcaagactccatctcgaaaaacaacaacaacaaacaaacaaacaaaacaaacaaacaaacgaagagctcagagcttcagcggggagatatttgtgaattagttcaacaaatgacataaatataaacagattacaaaggagattacaagagggaatggtcactcctttctggaaagttagaaaaggctttctagatgtaacgacactgaacttaatatttaaataaaactatatatgctaatatacagaaatgcacagttatcaatgttagatttagagacaaatacatttgtcagatgaaataaaaatacaagactctaccattccggtttctctatgattatatatactttattttgtgtgatggaatgttggttcatgaggatgcttggggaataaggtgttctagttaatacaatcttatggttaggtaaagaccacagagaaaatcattttttgttaaacatctggtggtaatttattttcaaaagtacactagcttttgccttgagttaattacagtctactaaccataatttaatcttcctttgatggttcaggatcatatagtgttctccagtcattctgcatcttggctgtgctcatctggtattggccatgcaaacttctcccaacatgtgtccttaaaacacacgtcatgttttctaagataagagctataacctaggtttgttttcttgacccaatttgacatcacgtaagtcatatatctgactaacttgattttaggagcaaatatatgactacaaacttctattactatttaaatgtttagcttattctaaatcatataggcagtgtttagggctatggaataatttagaaaccattgaatttaatctatcaggcaactaacaaatgaaaaaggtgagaaccagagaagtcaaaagacttgcttagggacccacagctcattatgatagttctggtctacagcttaggtctttaaactgtcaagtcaattattttccattatccacactacttcctcttattcaaagtttatttatctaaccctatttcagaaattgattgaatgagtaaagaagtaaaaaatgaagaattaataattttgaaattcaaatgagcaaagatatttataatccataatcaaagaaacagaaaataacagtagttaaggatcaatgctccactgaaatgtttatcaatttttatactaaataaaaataaatgcaacaaaaattttaatttttccaaaatgagtaaatgacagaaaaattagaagataatcaatttccataagcagtgcattatttagtatccaaagcaaaaataattacttaatttacaaccaattttcagtataagctattttctaagatttttatgctcttataacgaaaatttttcagtaaatattttaagtagagttatgagaccatcttcctaaaagcaaagatagctctttcattgaaagtcaatggaggcaagccccttgttcataataccaaaatttcacctaggagacctgtgaagacatggtaacaccaactccacaggcactacttcttctgctgcattggttttgcaaaagggcagagccaagtagatgttttgtataattaaaaatctttttttgctctctcttttgtgatacattttcccatttttatttttttccttcccttccatttcctctatcttatcccttaatatggtaggtaaataactacttctagccaagccagcttaaacatttactctttaactaaatatttggagagacagggataaaagcaaaaaaggtgtatttgactaccatactctagtgagaagtatatatgacacaacaaagtcataactccaatgtactgttttctcaagttttatcttttacaatgcttatgtttactattcggttgctgcagatatacataaataaggtcatgattctccaattttctttttactcctgggtatgccaagactagcataaagaaaggccgcagttaactttgaattaagtaaacaaagagaacagagaaatcaaatcataaaatatgcattatattcataagtattcatataacaggctgaccttgcctgaagaaaatccatctttgagggaagatcctcctgcatcagtggaaataatacccaaagcaatgaaagcacagctgaaaatatgaattgcatcccacatttcatgctacaaacaattctcagatgtgatgaaaaataaaattgtcttcagtctctcgtaggtctacacacaataaaaatctctcaaaaagaaatcaaggcaaagcctatgacatatcatataacctaatcagacagaccctatctacttctaataactgagctgctgaaagaatcaattctatttcctctcttgacaattttcctagagagtggggaaattggtctgtgtgcctgtgtagagatatacaacctcaggaaaccaaagaacaaatctggactcacactgtcccaggttctataaggtacatagggtaagtggatactatctctcaagacttcagaaattgacatgaggttagcacacagcaaataacctgaacatcagttgttctcagagattaggaaccatatgatcaaaaatggcttgaacaaccaggaaagactagacagagggaaggggctcaagtggaagccatgatttgcacaaatgaattaactagataaagatttattattaacctgtgctacatggttattcaggtacctccttgacattttgacaaactgtgaatggcattcatacttttggtctcatctcagaatatatcattgcctacaaagtttaaggctaaaaaaattcaagtttcaagcaggcatttataagatcctattgggcaaattctgtcaggcaattccagaattccatctgcaggctcattcattcagtcaaattacattttttccaaagctcatatatactaatgtgatgaaataaaacattactaaaatgcaaacttcatatttctttgagtttgaatccagatattactgcctcatttaccaaaaaatccccaaatacatataaatttaaatcaatttcaatgacaccaagtaagaattaaaaatagtgtgcatgtgtaggatcaagacaaatgagagaacattctgctttcaaagagcttactgtctaatgagtaaggaaaacatatgaacaacgagctataaaagcaatagaggcatgaaatggtgttgtgagtatatgaagacaggagattgcttagaaatgctgcatttaaggaactctatcttagattttgaaagaaggctcagatttgcaggcagagatgcatttaatgtgaggttattatcgtgacatagacaagagaaggggtattggagaaacagtctgtctgcctagaacattaggcacactgaggtgatggtggtggcagaaggtaaagaactttagttggcagacacagagagacatcagtggttctgagaagacaactgccacagtcacagagacactttagaaagctattatatcccatttctttccatccctttcgggcaaactctgcaaatgtatagcctgaaaaagaataaagattaagaagaagtttgttttaaggcaaggagacttggagcaaaggaggaaaagatacaagtaataagataatggaataaactctttaaaaagtgggatactatgcagccataaaaaagaatgagttcatgtcctttgcaaggacatggatgaagctggaagccatcattctcagcaaactaacaggggaacagaaaaacacggcatgttctcactcataagtgggagctgaacaatgagaacacacggacacaggaaggggaacatcacacaccggggcctgtcgggtggtggaggacaaggggagggagagcattaggacaaatacctaagcatgcggggcttaaaacctagatggcaggttgataggcgcagcaaacaaccatggcacatgcatacctatgtaacaaacctgaacattctgcacatgtatcccagaatttaaaataaaataaaataaaactaataaataaataaatgaatatttcattaaagaatgaataaaagaaagtgggaaccaaaaaggaactcaaaagcataaataaggaatctgtcagaagaaagcatgaaaatttttctgttttagaatggagggaaggaagatataatgaagcaagataacttttcagatagaaaagaaactgaggagtcccttcttaatatctcagaaaagtagaaggtgaggtctgctgatgggagcagggaactagctgtgctagaggggcttgatgagtggggaacagtcaatttgccttaagtattagtacttgcagcagtcttaggaaaaacactacttcttattaggccatttaaaaagagtattttccaaacttttttctgagtcaataaccatatccaaataatttaataatatatccaaaagtttatcttttattctaaaataaaactcttaagatgattaactataagctattatgtatgaacagtagatttaagactgttatattttttaaaaactgtatatatctctcataattctacataactacctagagtagaaaattgtgatactcatgctgtgcttcattgtatagaaatttagggaatatttactgatgacttgaatatttactttttagcatcattagtgactgaggtgattcttttcagtgaattaaccaataatttaacaaaggaaattgatgacgatattctatgccacatttcttttccgataccatgattaccaaaatatgtattgcttgatactatgggcagagtaaggtgtcaattctagtatatttagcaattaaaaaggaactccatgttttataatttattaatttctttctttctacctcccccctcccacctcccatccttccttctctttctttctttctttctttctttctttctttcttttttctttctttctttctctctctctctctctctctctctgtctgtctttctttccttctttctttcagacagggtccagctctgtcacacccaggctaaagtgcctccctctgccttctgcctcagcctttcaagtagctgggactataggtgcccaccaccatatctggcaaatttttgcattttttgtagcgacagggttttgccatgttgcccaagctggtctcaaactcccgggcttaagcgatctgcctgccttggtctcccaaagtgttgggattacaggtgtgagccactgtgactagccctcatggtttataatttctaactgtctacttaaaatgaagtgatatgggagaaatttatctggactcaaaatcaggaagaattttatttttatttaaaattagctttatagacactacattttaagcctattctattccctctttgggctgactgatagaaagctaagatctaaatctgtggccatcttataggaaggatctagacattctaggcatgtgttttggtcactaacatcacttctagcttcaagtactatttctacttttctttcccattgtctcatactgataattaacaatatgtacacaaacaaacacacagatctcaataatggggactattaaataaggcaataaatgtaactaggaactgtttccaaagttgaatctatttgtatatttcaatagtttgagcaacacaactgtgaagactaattagttccagctctgtgaaaaatgacagaagctctctgaatatgtgccttttccttagccttcaactgtattgattccaagagaagaagagctttcgtaaatataacagaaaaggtacatataacataactggataggagcactaattatttttgcttctctaaggaactgcttaagaataatatggaaataatatggtcaaattatattatctttgagctatggtcaaatttccagctactgtcaaagctcagcagcagacaaggcaaatgcatctgacatattcttggacatggataacttacaccggcagatcctacacacaaatcctgtgcagtgtactgaagcgggtggatgaaggttttgtctctgttgaacacccatggggttataaattcagatttagaaacatgtactttaataagttttgaagccatttgatcagaaagcattacaagtctcaaattgacctctacttttaaggtaaagcttcaactatcctaagtgttactccaattttaaacaatgaattaaagagcctgaaaatcattttcagtgtcattttgattaaccaattatatgtgatctaatttgatctttctcctcaaataaatgtaaacactaaagagtgtgtgtttggaactcttaatttgggtttcagtcagcattgagcaatatctaatataaacatattggcttaatttttatattcctcacacatataaataatttgaagaatgcaatttaaacaaggcaaccagaagttatttgccctgaaaaattataataaattaaaaaattgtttttagttttgaaagcagtttgccaaaatctgcaggcctgtgaatggtctgaattcatacaatattcagtgacttctcatttattgatgttatttggaatctcactttcattctttctcacatatcactgaagggaaaaaatttgcttaagaaaaaaacaacccacctaatcaagaattcttcattagcacagattttcatcaaaacaaacaaaagtagagaaaaataagaaaaaacaaataatcaaataaaaacaaagaaaattgcaacataaagtattttaatcattttgtccaatttctatcagacttgctctggtttcactgagggccttagataaggtgccagaactaattttattgcagcttctgctctctgattttaacatagatgtaaattatttgaataaatatttatagattatagtgagtctttcaacaggtaactagcaatacaatatagagaagaaaatgttttagtaatgtcttgtctatgtatattatttttcaaaacttatttcagtctcacaatagccttgtaatggaagaagagcatgagaaaacggatgctcagaaaggttaagcaattgtcaaagaaattcctcaaagatcacacagcagtgggtcactccttggcctcctgcttctcagtgcaaggctgtttccattggcggtacatggacataggtttaagatcccatctgccatggacaaaccgtgggtgaatccctgttggagcttgagtttcctcatacataagaaggggataataaaggtgctggcccatttctccaccactctatgggggagcccacgtggagaggacacatgaaagtgacctgtcaattttaaattgccaagtagtagatatattgctgttgtcattgatactaatgaacaaagcagttttattgctgaataaggaaacccaagctgaagaaatgttaatgtctaggccctaactaaaacttcctgcttcactgagggctctgagtacgtcctatcagcatagtaaacagtcagaaagcttttatacagtgactaaagttgactcttgaatgccgcaggggttaggatgttgatcttacccctaccctggaccgagcagttgaaaatctgcatatgatttttgactcctccaaaacctaactactaataaactactgttgaacagaagccttaccgataacctaagcagtggatgaacacatattttgtatgttgtctgtattatatactgtattcctacaataataagctagaaaaaatgttattaagaaaatcataaggaagtgaaaataaatttactgtactgtactgtatttattgatcccattaagttttcatcatctgtttacaggatgaattatctgcctgaaatggtggcaactgcagctgtagacctcaaactgcagtacacattaagcaatccagctttttctaatgtcatgactttcctctgcttctggggagcacttctagcattagtaatggcacttcctgtgggtcccatggtgttattcaaggtttaaactattgcattaaacatgatgaaaaatgtgcaagaaccaggagagatcactttttattgcgtctgcactttgctggccgacaaacctctcacacggagatgattggcatcacatggcgttttaagtggatgcttgcaacacttgagctcactgcagtagcaacaggagggaactacagaattattacggtagtacagcaggtacaacagttagttttatgcagatttaatactgcatctttacctgtgtttacatgtctctcatcatgaatggtgccatgtatggtctatgtgtgtgcaaaagttttggcaaattttaactttttataatagatgtatgtatatttcatggtagtaaatgacaaaatagtgtctacatatattttatacactcctaacacacctaactttttctttttttgatgtttctagattttttgatatttctgatattttattcattaaatagaaaccaccttaacatcaacacaatgcttacaagttctggatgaaaaattaaaaaaaaattttttagaattcattaaacttcatctatccaagtcactccaaatttatgtgaaatatttagttctaaatgatttcacaatactttcctacatggaacaaatagttgtaactcatcaaaagtaacaagtctgaaatactttagtcagggagacagtaattaggattttaagctaataagggcataaatattttagatagagaatagagacaatatcacccaaaactgtaaacaaagtgctattcttcttgaataacagttttccattgcatacatatgtgcttggggcgcccagatagtatggacaaaatacccccttattcccaattttgctttctgcagtttcagttaccctcagtcaaccatggtgggaaaataggtgagaacagtacaataacatattttgagaatgagagagagaccacactcacacaacttgtattacaatatattgttataattgtcctttttaattattagttattgttgtggatctcttactgtgtctaagttataaattaaactttatcataggtatgtatgcacagaagaaatcatagtatacataggattcagtaccctctatggtttcaggcattcaattgggggtcttggaatatatcccccttggataagggagaccactgtacacacaggtctggaaaaatcctcttttttgccagaaacttagtgattttatgtcaaggaggaatattataaataattctgacttgggcttctaggtaacagtagctggtgcctgtcaaacattaaaagggattttcatcctgagaagccataaggaattctctcttatggtggtgaggagagaaagtcagggatttctttggtcattgctactaccatgagtggagacagcctgatggcacatctgatacacagaggagacagtcagacaccccaacaaaagaaactagctcctcttgcagtgagctgagatcgcgccactgcactccagcctgggcaacagagtgagacttcgtctcaaaaaaaaaagaaaagaaaagaaaagaaaagaaaccggctcctcaaggcttcacagatctctggagcaagctttggctgaaagcacaccaccactgtattgttgcaattcatgaatcaataatgtttccatttttgctttagatagttcctgtcaagttccctgttccttgctgtcaatagtgtcatacaaatgctataattaaaacgccttggttgaaacaggtttggttggctggtgcttccccctttctagatccacctgcatgcccatgaagatggcatgaaaccaagaaatagcaaggttgtacagtgtttcgcctgggttgcagttttctgcctaacctaccctctcaaaatgagaagagattatgctcctaactgcttagggacaaggatgacctcatgcagatggggttgattgatgaagtacatagtctttcgagtgaagacagaactgagtcccaattctaatgcacaattcaccagctatgagatcttggttatataactaattctcctaacatgtttctttattatgaaatgggatactaatagttattatgccagcaggttgtgagtattaaatgagatagcacatgcaaatcattcaggacaatacctagcacttgtaaaatgtcataaaatattggcattcttatttatatattagcagagttaagtttccagaagctataaatacaggcaaacattgcatttacaaaagtaggtacttgacttttattatttgagctataggggtaacaagtgaccataagttgaaaatggttatttgattttgcatgcatgcaagcacatgtgaaatatgtgtttatatctgtagattttgtcttagcacaggtgaaatactgaaaacatgaaatattacttaaagcatgaaatgctgaaaaggcaaactgttcttaatgtatttcataaacaaaacattactacatagaatataaatgccaaaattcctgctttggagtttgttcttgtattatgtcataatgactagccattaaatgtaactcatttttttggcttgtcagtgggaaacaacattctcgtcctaagtgcagcccgggaggagacagcgctatctatggtaacacctaggcatccttaaaagacagataggaatatgaatcttgtccatttcagggacagccatttcttgctgaggggctaaaccactaagaaaagaggagacagagcatcaggcattatctcttcttggaagaaatgaatattcatattactattcattgtcactagtcactattgaagtgactaaaaattagtaaatttctggtcatcagtggacagctgcaacatcaacaaattatttgaaaaatcaacacctgctgaaagcatgttttccccaaaaccttattgaagtcccaaacatcagagttgtcaactaacttctataatgctatctgaaactgcaattaaagttcaaggtggtagaatagcaaactagtgacatcaaacagcaggggagcctctgggctaagatgcagttagtccacaaacatagtccctttgcagtctagcagggaatgatacatcagcaccaggtccatgacaggaacccagcatcgctgattagtttgaaattttccttgctcatttgtgcatgaaaagccatatatcacttaatgccaatgaccaagagtcttctcaaaccagggtcaaattgctaaaggctatttttttcctagcatattgaaaaacctcattttttcccaagaactttcccagaaattagactaagcagcaaatattttccctttacttcagatttattgtctgggctaccacacacccaggtggcagcaaaaaacactgaaaatgtctgcatttggctggtgtggaataaatggtcttaatagctcacaaatatctgaggaattaaacctaggaagacagcatcaccacattgagctgctgaagtgcatgtctactacttcaatttttagatgacaatattcaattaacaaccatggtatcatattagtcattattaacacttactaagcacctctgcctctagtatgcaaagtgcagaattcaagtttaatatggtgggactctaactgtcagatggcatcttcactggatttatgcttctctatgaaacaatgggttcctttccaagctaatcatcttaagtttctaagtatttggccttcatttttatatatgcctaatatgctcagaaacaagaaatgcatgactaatcacaagtaaatttataaaagaatacattttctgcttagagtgataagtatctttttgatgagaatgatttagttttattgagagagattaaaatttaaaaccagcaactaaaatcttagaaatgcttccctttaatattctcagggatgataaacagaaaataaaaaaaggagaatttgagaggcttaggaggaggaatccctcaaaatgcatagaagatatttagatctatgaaaataattcaaagaactggctctattatataaaactggaaagatccttctgttctgatgttgagtgtctctccctaggctaatccaaacggctcagaaaggtcatgtgctataacagacaatagctttagaagatcataattttatcttttgttgctttttgatgttaatgagtaaataatggcatttcttgacaaagactagttacatagtgataactggcagaaacctctacattttgaccagagtgaatactgtaggagtcacctcactatatagtgtggggaacataatggactgagcctgcacaaggaaaagaggccagggtagcccatgtgatggctcggcttgccctgtctattcagttctgatgttctctgcaggtcagaagagaggacctttcccagggactcaccaggtatgaggtcaagcagtggccagtgtcaaaaaaaaaaaaaaaaaaaacgagggaatacacacaataccttcagttaagaggtactatgatagcatgaaaagaacactagattaaggcaaatgtcagcagactataaaatacattctcaccagaagaattgcttgaacccaggaggcggaggttgcagtgagctgagatgagattgtgccactgcagtccagcctgggagacagagtgagactctgtctcaaaaaaaaaaaaaaaaaaaaattctcacttgagaaagttagataacattctcacttgcaaaagctaaataaggccaacgatcactgagatagtgattgccagtaattacaagaatctaagcgaattctcttttactccagatctagtatttccacatcacctctcagttagcagaccaattcagctctcctgattatgtacccttgtataagtcacttccacttagtgggacttggtttcccatctataaaatggacacaataattcctgccctgctatcttcctgggttactgtaagaactaagtgaatctccatatgtgaaaacaatatgaaaatgaaaatcactagatcattgtaagatatgaattttaaatccatggcccttctcaatcacagttttatagatgtcccatcacaggccttctgtgtcatgacttaagttccaacatagttcatttgtattcatctttaaatgtaagtatatccttctccttaaagttctccacaagtccttttctgtgaaaacacaagatagacatctactaattattccatctcactgtgccatattaatctgtagactggagtatgaggccccaggaggttgggattctgtctgtatttgttaatatactaccagctgctgtaacaaacaaaatccaaaatgcataggggctcattctcaatagcaatctaaaatgtgtgttctgatagatgggtggctccatactgggaggaattaaaaagcccaaactccttcaaacttatggcttcaccatctgcaacaaggattcaatcttctgccatgattatgacaaaagcacagaagcatagagggtaaaccaggagagggtttgatgagtcaggtgatgaagttgcacacagggacttccccccacattccattcactagaactcagccacatggctcatctctctgtagcaaggcctgggaaatgcagtctaactgtgagtccagtaagaacaggacacaggtttggtaaacagccagccagtctctgccaccctcatactcgaaatttaaaggatgctttctaatgtatgaatgaactgactagtacatctgagtcttggccatgaagtaataaaggaaaaaaaaaaagaaaactactatacgtaaatcatgttcacagctctaattcacttaatttcacaaatcactgtttgcccttctattcctaatatatgcaaacccaattttaaggatgaaaaatgacattgctaaaagaaaaaagaaaagcatcataaacaaagcttaaagtttctaaaaaagaatcactccctaataagggaatatcatggagagaagagaatcatgaacagatagaattttccagcaatacacaaagaaaagataaaaataatgtgatagcttctacttgctgtgcaatttactttggaattttacatttttatactaagaggtaaagtcctgccatgtttctgtagctaagctagactttacaacataaaattctgattttgatggtttaatatctaagttgttttaaaataaattgagtttaaagactgaccaaatgtatgaattaaaaaaaagatctttggcatttttaagtaaagtcactaagtacagcaagaatgaatgcagggtcttttaaaggcatcatataaaactctgtagtatatacttttaaatgtctgcatttgaccaggtcaagattgctagtgtatttaattcttactaaaagaaatctatgaagtataagtttaaacttcatttggtaactaagtgcatatgccagcatttcatcataacctagaagtttcaggtgatgaaatgctacagtgaatgctccaaccaggaggatctctttactttagtggaatttgcttcaccacacaagctttcaaaatagatttatttctgctattttttctgactatattttaaaagagaaatgacataggtttcacagatgctggtgaaataattacagttgcaaaggcaaggcatataattagttgaagaacagggttaaaaaaagatttcacctacactacgtgggtacaaagacttagggttaactgtgaagcaactgctgtctgcatctttcatagctataaccaacactgaggcaaaaaataccccaactatatatatatatagcatacacacacacacacacacacacacacacacaaaactcaggacacaaagagaagatatccttcctaaactcaaaagcgcacagatgcttacactgaaaataaagtcagtagttgccttcactgcataggcgtcagcaaaaatcaggacagagcaaggacaggagagagaacaatgaagaatgattcctcctttcctataatcaagggccacaattcactccctgagacacagagagatgacttctcttctttggcacccagtgtatgggaacatcactccttcacacacccctgactcctgaggagtgggaggctgaaagtaccaggaaaggaaccaaatcatctcattttcatatgaacctgttgaactcctaagcatttcaacttctaagctgaaagagctcttaagcatgaattatcaaaagctgtttatcacctgttttcacaatctcctaattctaagaagtttccaagcaagtctacaatgacacagtgcatcaaactctagtacaaactttaattgcatatggaagcacaatgccagtgtattttattcaatatgtataaattttaattggaaaaattttctcacagcttaaacaatcacaccttagtgatgaagagctcaaaggacttgtgaataattataaatgaatactatacgtagttgtggcctggagaactccactcaatttcagaaaatgttacaccagtactaaagtagattgattgagtgtcccacaaagacagcaggtaagaggtggtttggaaggcaggtacaataatagggtcacactctcctgatctggcttgacaccatgataatttttagaacatcaggattcataactctagtcctttcagaggaaggcaggtaatgaagatgtgtaaagtggcttgctgaagacaagaaagagaattattagtgcccaaaagccaactgaagacttaatggcctgcctttatgtgaatcaaattgaaaaaaaaatacacatttggaggtcctgagttatgacccctgcttggaaaaacaaatgccagcatacttctgtcaactaacctaactaacctttgcataaggtattaagcaacagtaaaaagttaaaaattgttctctgacacatgttggggtgtagatactctagcttattagtcaaataaggactctatagtcataatagatggtctgtgggagaagggcaaagctgacatccttttaacaaaataaggcagcctaataatgtgcttgagattataaggccattccacctcaccttggagaaaggcttaaaaaaaatcccacaggaaaagtgctagataattattgtgaatagactttttaaagatgaatggagaatagtcatcctttcaattggattccacaggccatggccacaaattttagcctttgctccccaaaataaacaaacaaacaacaaaaaacacataatcaacaagttcccttaacagtgtgctgagtgccaccctacataacgccagattgtgaggtatatacccttcaagatgaactagatgcaaaacatacaccaggtataataaaagaaggagaagatgggctgtaaacaggggagtaattacatgggctggcaaggctagcagatgtctttagggaactagagagccaaaggagccaggagggcctggtatgtgaccctggccacttgtaccagccagcctgtgcacaagagggaacagcttgtgctccccatggagggacagggaagcaattaactccaacattcccttctcaaggaaccccccagctcctctctaccccctgaaatcccagccagcctcagagagtatcatggtaataagccagatcccaacactgccccccaacaactgccccctatcccaacttgggaaccttttacttagagcttgctctttctgttggtggaagaggacacagagagacaaaggaatcctgccttcctttgctcatcttcagggctttccaagtagggcagagttttacagaaaaaaaaaaaaatctacttttcttcaaggcgaggaccttatacagaaaatagcatatgggaacagtttcagggaaggtctgagaagactgcgtgtctcctgacctagctctaccatctcatcaacttgctgagctcatatttaagcatacaagagctcttcagactgcacatagattttataatgccacctaccaagggcctaatttggagggctctggtagaggcttatgaaacaccaatatgtagggtgctaaaagccttacctttcattaatttaacaaatatttaatgagcatataccaagtgtcagatgttttgcctggtgccaggtctacaatggggaatcagacatcatctccgtctgccctgcagaaattgtgcctagaggacagccctctcaacacaggttagaactactgttctcaacctggatagatctcaatacatctacacattaactaacatcttcgtctaaaaagcagtattttaaaaaatttcatcatcaataccaatacctgtactgagtattactgtacctactgggttactgccctgtagatctgccttagtcttattcactgtcagtactcccaatatactcacattttggagaaataggatacaaaatggcttatgttctcaagtagcttacaatctcctttgagaaacaaaatatttacatgaaaccataaatgatagagtggaaaagatactatggaaaattcatgcaaatattcaataaacaggctgcataaaatttggtatccaggctgctctgcctatggagtagccattctttattcctttacttcttaataaacttgctttcactttactctaaaaaaccatgtgttatccaaatcataacacttctcagagcaaaggggagaactattaatacttaatattgggaatgtctctggcaattcaaaacctaagatcactattttcacaaatccctttttttgggaggtgaattctctaattcaaaaaccatattcagttcctcatcaaagaaatatttatggaaaatttaccatattcaaggtataatggcaggcttttctagaggtaggctttgagcaggagctcacagagataaataagacataattcttatttatctatttattcttatctgtctgtctatctaagacattaaaataccataaacgcataccatgtgatgttcttatgctcagctttttgcatatacattatctcatttagtcatcaaaacaaccctaggagataaacagtattactactattttatagatgaggcttctagtggttaagtaactgtccaggatccacggtccctctggctgtaaggagctggcattggaactaggtacatctcattgcaatacccagctcctactctgtgacaggtactgcatggattattctgaggaggaaaacatgtatttcttgttagagtaatcaaggatgactcaacaggggataagtgatgttacatatagatcttgaaggactgagttagaaggattttaaaaggcaaagagtagaggggatggcaacccagggaggtggaacaatggaccaatagcctggagctggaaagactaagcattgagcaaggaggagtcaacttggccagtacttcatagttctgagtagaggacctaggaactgtaagactggaagacaggtaagctgaagtcacctttccctttgtgtttaatttaagcaaataggaaactcagtttgcatgccctgagtacactccatagtgaatttgcattgacgccaaccagttcatccaggtcaagatgtctgggaggtagagggcttcatacagctggcctgaagggggcattctatcatccaaaggcatgacagtgccaactcatggctggatgtagttctggcaaaactgaaatgatgtaaatcaatctaatttttttccatagaaataatgttataatgagtgtgatatttcatataaatggctggatacccacgttctcataaaaagcaccccaaacgccttaaacagtagtcccataacttgtatctgctgaagaataatatcttcagtgtgtacatgtaaattaaattggctggtgtcatagtcataattttaataagtcgaaactatcccaggagacaaaacctttgcaatattgggagggactctaggacaagtcaaagtgactccaaagagagaggctatgcacaaggccaggaggccaccagctggcagaaagctgccataaagaacagaaggactggccagtgacccaaaacctgtggggtcaagtcgtaggcaaaaggattacaagatcaaggccagctgtagagcatgtccctacctccaggctcttcctcatccacataaagtctcctaaagcaatatttctagtcttactgctctcctgctcaaagcctttcagtgactccccatttcctacccagttccaaactccatgtctatcacttagggccctccagaatctggtttactgtccatccagcctaatcttccactacatctactccaacaagctaggctgtagaaagatggcttagtcattattctcaagcataagaggcatctttatgcctttgctcaggccatgagcttggcttggcagactttccttatgatctgtatcatgatctattaaaacttacctagacataagacccaactcatatgccagctgtttcatgaaacttgatacacaagaaatgctctgtaaatatgtctgtgggtgaatggatggaaggaaggagggagggagggatgaaggaagggacggatggaagagatagaggcagggatggatggaaggagagatggagggatagatgggtggacagaggcaaggagggagggagagatgaagaaagggatggagggaagagagagatgtgggagggatggatggatggatagatggagggatgaatagacagagggaaggagggagggagggatgaagaaagggatggatggaagagagagatgggggagggatggacggatggatagatggagggatggacagatagagggaagtagggagggagggatagagggatggagagaagaaaggagggctagatggatagaaggatggatgaatagaaggatggatggagggatggaggaaaggatgggggagggatgaatggatgggggatagaggcagggagggaggaaagtatggaaggatgaatggatggagggaggaagggaatgctggatgaagggataaatggatggatggtggaggacctcataacgaatctctcagctggtataatcattctcctgtcagtatgccatagtacatatttgttcctattttaaaacgttgcatgctctcttcttccattaacatttgaatacagctcttctcttccttattaaatgaaaggctcctgaaggctgaattatattcatctttgtatcccacacaaatccgagtacaaggtctttcacagaatacgtgcttaagatatcacagtatcagtagtatggtatgcccagcagcaggcagaaaacatgcataatggaaagcataatccatgtaagggatgaatactagatatgaatggctgtaaatggacctacgtcagctttaactattccagacaaaagtcaggtctctaatctgaagttacctttaggcagagacagacaaggtcatcacctcttactcctccttcaggcctcaattctggcaccatcttttccctgaagcctgagaacactcgccctgcctcacccatcctgagattctaagccctccctctcctcactcttggcactgggcacacacccctttaagatacaggctgagtgtgctcctatgtaactactgcccccgtgtctctcttcagagcagaagagttggctttgctcatctctgtgacccattattccagaacagtatttggcacacacttggctcttaataaagacttctttgtaagtacttcattttagaagtacttagctaatattctgggttttctgtttgtttgtttgtttgtttgtttgttttgagatggggtctcactctgtcagccaggctggagtgcagtggcacgatctcagctcactgtaacctctgcctccctagttcaagtgattctcctgcctcagcctcccaagtatctgggattacaggtgcccaccaccatgtcctgctaattttttgtatttttagtagagacggggtttcaccatgttggcaggctggtcttgaactcctgacctcaagtgatccacctgccacagcctcccagagtgctgagattacaggcatgagccactgtgcccggcccaatattctaatttttaaacatctaccaggtacaatcatcattgttaacaaacccaggatatgttgctaaatctcttagggtcataggacataggctaggctttacagtcaggcagccccagctgggaatatcagctctgcttcttctaggtttgttctcttgaataagtcacttaccctctctaggctgatttcctcacatcacatcgtccatagggataacaacacctaccctgcagaatgttgtcagggccacaggttatgtaaataagcacctaacagagctcccagccattggttgttgctcaataatgatagcaattataatgactagactaagaggataggtaaaagtaaatgttgatatatttttttcaatgactatacgtatatattgtttttaattatagtgtatttttacaaaatcaatcttaagaatttaattcagtaaccccatacatagtccacatctttggggctataaattatttgtcatgctttcagtaagaaactcaatccaacaggcaaaggaaacataatggaatacatagatgtcttgagtttatagaaaaacatgcaaaatattaggctaggttcagtggctcatgcctgtaatcccagcactttgggaggccaggggggcaaatcacttgaggacaggagtttgtggtcagtatagccaagatggtgaaaccccgtctctattaaaaatacaaaaattagccgggcatggtggtgcatacttgtaatcccagctactcatgaggctgaggcaggagaattgcttgaacccggaaggtggaggttgcagtgagctaagatcgcgccactgcactaccgcctgggcaacagagtaagactctgtctcaaaaaaaaaaaaaaaaaacaaaaaaagaaagaaagaaacagaaaatgcaatatatggcacaggaggtaaggctataggatctgtcttcaaactgatttctgcttcatggttttccaaggagaattgaaaaaaataatcagtggataggaaagaggatgtttcctcaacattaaatattcaaagcaggtcaataagagcactacacatcaggaattcttcatcagtctctgtgcctcccaaacattaactatgtaagcggtacatgtgtacaccatattgagaaaaaccgatgtgttttggacagagtctccgaagaacaaaaatgagtgtctagcttcctgtgtaaaccaatgtcattacattcaaagaacagtacatcaggaaattccctagaaaatgtctgttttcatgaggcacgtgcatgtgtgtgtgtgtgtgtgagagagacagagagagagagagacagagagaaagcgcaaacaagctgatggcattccaccatggaatgacctcagagcactgtaaagcaaatcattaaaaatgcaacacatgcaaactcttccactgcagatgcagagggattagtgaaagcagagtggtcacttaagatcagtttaagaaacctggctgcttacaaatgggagtaagtaggtggatttttccaaaccaccctatttacatcttctaaaccctatcattttgtgcaatggctaaaatttcatgcatgtcacgagtgtttcccctccccctacacacaatgtagctgctttgaagaatgtcagattagaaacaaggagaaaaaagagccattcttttaaagtctcaaaaattcacaactaaatttaaattacacaactttcagttgaagtaagaaaggcagagccaacagtccttacatcatggtatgagaatacttcctaacacattctctccacacggatttcacagacctcaccccccatgttaagtgtgtacactaagttaaatcctttatgtagcaattatcctaacagtgcctttaattcttcaaactaacggatatcatatcaatgagtaaataaatccaaaagaggttctgattcaacctcagatgaacatggagtagctgaagccagatttaccctcctgcctgaaaacagcgatagaagtagacaacatgcatgaaacaatagctctcaagatgctgggagccacctggcaggaagggacagtggtccctgaaagaagggaagcaaatgaggtgaactctacaattgccccagcagctggcctggagagagtgttcaggccatggcctaggaaagggtgacctaggcagagatcagcagtccccgagtggaggacttggagatggaagtccagggagccgaagatggttaaaggtcacagggtgaaataccagggaggacagcactacaccgagcgaaatccaaagagctgtgaatattcagttgagtactgattgatcagcacgtgaggaaactacctgcagccagggaaaaaccacctgaaagtattagagggaacagtgcctagtattcacaaagggccgccagctctgttcccaacagccggaggggaaaatcccataatttatggggcattggttagagtactaagaaaggtcttgccttgatagtggagaaaaatccactctagactaaatgctgccctggtcctacctaacaaagctttttaaaaagcaagacataaaaagatcatactgtttctaagtatcctataccatgccccataacaaacctccgtaaaatttttaggaattcagaagtttctagtagccaataaggtaaaattctggcatctaatccgaaattatgaagtagaaagtggaaaagtgtgacctataaagaggagaaaaattaactgatcagaaccgacccagatgatagaattagtagaaaaggacaataagacagttttttaaaaactgcattccatatgttccagaaactaaagaatggctgtgttaagtggaaacaatatggaaaagattaaaaagaccaaaattaaacccctagagaggaaaagttcaaaatttgatatatataatacagtggatggcagattagacattaaggcagataatacattattgaagaaaagattagtgaacttgaagacacagcaataaaaatgattcaaagtgaaacagacaaaatacttggccctacttgaagtccacaattctgaaattgtgtctgaaagttaaatgctaccacttattctgaggctcagacaaaattcattgcatcattcaagatcaactgaacactgtaaaaaaagtgtttatttttgttaataaaattatgactttataatatttaatataattatttcactttataatctttctattgatggatatatacactgtttataagatctgtcactgctatgtatacagccaaatatacatcaataatgaaaacccataggcaggttattatttttcagttactatagtcagaattatattaatgcaatcaaaattgttatgagggctaatttcacttaaagggttatattctttgtttttctgatctagtttctgactatcttttgtttcacctatgtctctctgttatctgtggttgaatcttctggattctgaaaatcattcacacttatgattttattaacatatatacatggatgacatacatatttaattgattttccttaaatttgccccttcattgtagtaagagatagtatattattaaatcatttaaattcaatcatgtataagatataagacattatgtctggatgctccatcatcagttcagagtttttttttttttttttttgagacatgatcttgctctgtcacccaggctagagtacagtggcacaattatggctcattgcagcctcaactttcaaggactcaagcaatcttcccacctcagcctcctgagtagctgggactataggtacatgccccagaattttttatttttttgtagagacaaggtctcactgtattgcccgggctggtctcgactcctggactcaaaggatccttctgcctcagcctcccaaagtgctgggattacaggcatgagccaccatgcctggcctcagatgttttttaatatatttggcttctctttacaatctttcctctatcattttattgactttctagcagatccatgctggtcactgcaaatataatgatgaataagacatagccctcagagtctatggtctagagctagacaggtgaaaaataattttacaccagatctatggtcaaatatggacaaagcactagcaagcagaagcaaggagatgactaagtgtgctggtgagagggatatgggaacacagtaagaaaaacttcatactggagatgatcttttatgtcttgaaacatgtgcagaagttcatctaatagagaaattgaaatgtgacatcagaggcagaggaaatagcaactgtaaatgcaccaaagcataaagaaaccaggtatattctgggaataaataaatgttggtattactaatgtataccctaaagcactgggaagtcatcaaaaatttctaagtttgggaatgacatgattagatttgtcttttagagaaacaactttggaaccagtgtggagaatggtggggagttgagtggagacttcgggcaaggacatcagtcaagagttgactgcaatagttcagggagatatgatgaagaactgaattgggcagaggtggtgggttggaggaggctgattacagagatatttaagaagaagaattgacagaatttgggaatcggttatatgtgtcagtgtgatgagaaggtgagaaaggagtgaagggtgagtccaaggttctagcttggatgtctatagtgatagtggggctttgcatggaaagaaggtaggacaaacaagtcttgagggaaaagtatgattgtaaacatgtctaatttgaagtttctttgggctatttatgcagagatatctagtatatagtgtatagaagtaggaaactagagcttctactacagaatagtagtcaaagaaatcaaagtagataaaacactcagtctttgcaaagtatatggagtaacaagggaaatgagaaagtcttgcttagttcattttgttctactataacagaataccacagactgggtaatttataacaagcagaaattttttgctcatggttctggaaactaggaagtctaagatcaagccatggccttcttgctgcaacagcccatggtggaagggcaaagacagacaagagaccgcacaagagagggacaaagggggctaactaatccttttataaggagctcactcccaagataacaaacccactttctcaataacagcattaatccattcatgaaggcgtggcctaatcacctctccttaggtctcaacactgttgcactggggattaagtttccaatacttgctctttgggggggacacattcaaactacagcaaagccctctgacagaacaccgcactgcaacatttaataaggctgattgggggacagaatcaatgatggagactgaggagtaatcgggcaagtagcagagaaaccaggggcaattggagtcaagaaatccaagggagtagaatatttcaaggaggagaaagttcaaacacaatagaaaagtcacattaaatgagaaaattttaaatgtctactgaaattgccaattgatagatcattgaggccttttacatgaataattccagggagactgagatgttaaaaccagattccattaaaacaaaaggtaaagaacttgacatttctaacatagattaatctttatgaatttcaagctgggcatggtggctcaggaagcctagtcaacttattacattaatattaataatgataactgtgatcctcttaagtgattatggagtactcattatctgtcaggcattgtgctaagcgtttcacatgcatggtcttgtttaattctagataatttagatgactccacaagagtctttcttgaatcacaaattgctagtcttctgcacaaaatatccaacttgattatctgtactttaagaataagaactgcgtcttataattcccttcttttgtgccatctggtaaagttttggggacataatagaaactcaatatcctttaaaactcttgataacataccaagttcttgctatacacataactttgtattggacaatagagaggatttttttttacactacccaattctatacaaatttggaaccttattggagacacaaagcatgcaggtgaaaatttaaattatagctctaaacatcaattaagtgctactacatttataatagtagtacatgagtgcagtaaaaaagagattgctatgagctaatgtcatgaaacaaatatttatgcagctggtagaagttaaattagggcttgaatattctgacaggcaaagacaaggctttccaggaggtggaaatgcctgagcaagggaatggtcatgcatctcacgagagccaagagttcacagccaatgatttatttagcaaaatcttcaaccctactgttctttgcccccagttcagcccatttccagaatatattttttccttccttatatttccttaattcatctctttgtctacttctcatggtcacgagctctgttatcctatcctatttcaactacgaccacctcctcatcactcaactcacactattagcaccgctaagaatccacagttctacttctgaagtcgctttggatttcctagcactctgcacaacaggacacatagactaccagataccatcccctgcgtctggcatttctcgttcttcactctaactcactgctgttttccccacacaaatgtgctccaagacctcctaaagcaaactatacattgtcctcttccaagcctcccctggctcaaagtcaatcttaatgcacaaggctctaaatcataatttacagcttggaaaccattaatcctgtacagaaggaactgagtttactgccaatgagttgttcaaatactaagatagattctggttctatatgaatttttatttaagttccctataaaaatgtttgtaatagcaccagagggtgtgtgtgtgtgtgtgtgtgtgtgtacatatacatatacacacaaacacgctatctctctctctcaaagtggggaggagtgggtgttgaagaatgacagctccttgaggacaggacacacttttgttcaactcgacttgaactgtattagcaagggcatgagaggacttaagaaacaatacaaaataaggcagataggtatgttcttcaagctatcctttgatcctggattctaaagactaaaatacaaactaaggttggagggcccaaattttcttctctgagtctcagagattaggtctatatattttagaaatgtaatagtaccttcttaaaaaattacttggtaattaacctgactgaaagctctggctaaaatactgtggctccagcttagaatactctatggttgtagccaatgctagaaaaaacacactttcagttctaggctctgttctctcactaaatttcactttggctgtatgctgatcatttgatctcatttggagacgaccagcagtcacatatacaccatgaagtgacaatcacaatgccaaatctaagttatttcatttcaaataagcattggactattattactaatttaataagcaggaaatgcccatgtgtcttatgtactatgctggacacaacttgcatggagataaatataacattactaataagtacaagatcctcaaagttcacactctgagatgtaaataatgaatgacagcacaatttttaagagtaaagaaattgacaaggcaacggaagaacaccaagtaggaagtgaagataagaatctgccttgaagaattgtaaaatgatgcgcaagaaagtgacacttaaagtagatcttggctgggtaggatggctcacacctgcaattcccaacgctttgggaggctgaagcagggggatagcctgaggtcaggagttcaagaccagcctggccaacatctctactaaaaatacaaaaattagctgggcctggtggcacatgcctgtaatcccagctacccgggaggctgaggcaggagaatcacttgaacctgggaggcggaggttgcagtgagccaagatcacgccactgcactccagcctggtcaacagagtgagactctgtctcaaaaaaaaaaaaaacaagtaaaataaaaataaactaaatctcaaaggaggaaggaagggatgtgtatgaagcatgtattatttgccagacacaggtgacaaattacctcattgttgccaccattttagacatggtgaatctgaggcaggacaactaaagtcacctgctagaatgccacacagccagcttcaaacacagctttgtatgttttgtccaatgtacaagctcccttctaaaggcaaggaagccttctttaggtggaaaagtgaaataatctttattgcacttaaagtttcctaaaaattacctcttacgaaatatttacttataatgattaacagtttatggttgtagctgtaagtttctatctgcccatacaacgcttttaaagccgggcacggtggctcacgcctgtaatcccagcactttgggaggccaaagcgggtggatcacttgaggtcaggagttcaagactagcctgggcaacattatgaagcttcgtctccacaaaaaattagccaggcgtggtggcatatgcctgtaatcccagctacttgggtgggtgaggcctgggaatctcttgaacccaggaggtggaggatgcagtgagtcaagattgcacaactgcattctagcctgggggacagagtaaaactctgtcaaaaaaaaaaagaaagagagagagacaagaaagaaagaaagaaagaaagaaagaaaagaaagaaagaaaagaaagaaagaaagaaagaaagaaagaaagaaagaaagaaagaaagaaagaaagaaaaagaaaagaaaaagaaaagaaaaaaaaagcttttaaaacccagtccattaaaaaatgcccaggaaccaggcaaggtgggtcaagcctgtaatcccaacactttgggcagccgagacaggaggactgcttaaagccaggagttcaagatcagccagggaaatatagcaagaacctgtcaggaaggaaggacagaagaaaggaaaggagggagggagggagggaaagaagggaggcagggaagaagggagagagggagggagggcgggaaggagggaaggaaggaaggaaaaaattagctgggcatggtggtgtgcacctgtagtcccagccacttgggaggctgaggcaggagggttgcttgagcccaggatgcaatgagctatgatcactccactgctcttcaggctgggcaacagagtgagaccctgtctcaaattttaaaaaaagaaaaaaggggaaaaaaagaaaaatgcttggggttcaaggtctatgtaagagatatgcaaaacttcaaaaatgttgcaaaatgttgtgtctatgtgcattttcctggggaaaagagtcaggagcttttatgaatcttaaaggggtttataaacctctaccccagaaaaggctatgaagcaagaatctacaaacttctgctaagctttttaatgttttccaaaaggaaaaatacttttgtaaatttaagtttcacatacaaggaaatccatttcatatataacagggaagaagattcatatattctactataaggtaacaacttgataaggagacaccgaagtgaccctttcccatgtttctaataactattcaggatgttaacagtgaaaggaccatttagaaagctaatttccttttcatcatgcttgttaagtgtttactttaattcacatcctgtgtgaccctatgggaaaatttttaactaatactggggaaaatcccatagggttacacaggatgtgaacagggcctgtactgaactaccttcagcttgaaaaataaaattagataggtgagtttcactttctgtttgtcataagttccactttctggctcccaaagcttagatccacagtacatccatgtccgtgcaataaaatcccaagattctcactctctgttaaaggaaggatttcggcgtgttgtatagcaaaatcctttcagcagaaaaatgcaaatctgtggtgctaatcaaggagaggcggctggagcactcccaaatgctcctccatacctgggctcacacacagttcagctgccgttttccatttcctgtggggaacatacatcataccacttcccctatagaaaaaagaaagcagcccgatttaattgctgatggaaacattgtcatactttccactggccaagcttgaaactattactgatctaaccttcattaatttttccacaacaatttgcagaaatgtcaggaagcagctgtacgaagactgattaattgtccttatcaccactactttaccaggctcgctctctcttctctctctctctctctctctctctgtatcctcaccacctcccctccctctcttccagtttaaaaatataattgggatttttctgttttggttggtattggtggtggtatatcatactctgaaatatccagatctatttttgatgtctttcaatggcccaaacattttcagatctggaggagaccccatgaagtttgggacagcatccacgaaggaaaaggttgcttcctgctgattactcagttatagctgtttaaacagacgttcatgaattcaagtcttacagcaacactgcatttattagtcaatcacagacgctaaaattcacttccgaaatgtgaattagaaaatcaaatgccctttttctatttttttttcactttcttttctccctcatcattttcatttgagctataccatctgtcccagcctatcaaataatgtactgtgcatgcctggcaaaaacaagtggaacagtacacctcataaccccatgtaggcaaccactgagcatctataaaagtggtacataacagaatctggccatctggggataactagttatagcaagcttagcttctcagccagcactcagatttgcagacttttaactagttggcaaagcatcaaccagtgttcaagaagagaaacactaacaaacattttttttttcaaaacacaagaattcagatataaattttcaaaggtgtacttgccaatgttgctgacaagaaggcttcaaaagcaaagatcaaggcactgtcatgtccttgaaatggagccagagtcaatccaaatctagcattttgcagcattactaaactttttgggtatgaacatatttttccttccccatattgcctgaatatatacaagcaagggattaaagccgaacagactttgaaccaaatgacatagtacctttcagagacagctccagcagactgggaagagttcctcctaggactacatttaaaaaaaaaaaaaatccaaaggctcttcatcccagatacactcattcgtagtctaaccccgaaccaaagaaagacagattggacaactatggcttaaagcattaaagtaataactggacatgtagcatagtggcccagatcatggaccatggagccagaatacttgctttcagtcccatctctgccacttgccagacatacaaatattcaggcaagttacctaacctctccgtgcctcagtcttttcatccagaaaatggggatacaaataatattgttaacagaattatacagcatttaaaaatggcacgaggaagtgaactctaaatgctagctgttaactgtatatttttctgttgatatttcaggtatctattagcctaatagtgaggaggaaataatgtgacacgagttcctaaattaatttaacaaagcccactgggttggctgaaagatttcccctgataatactcacattgcttgaaacaccaccaccaaaactaggtcaagcaatcaaggctaaatattctattgtttctgttgactatcccctagctgtcacaggacagcatgccttgtgatgccatgggacatagaggcaggcatggctggagatgaccacacctcaccaccacctccaggcctggaaagcaggggtggggagaaagccaccacagaccagcaaagtgcaaacaaagacagaagctggcttggacttcgtcataatcaaagtactcatcaaagaagccaaaggcactcattcccttggcactaagaccagggttgaggtgccaggaggccacacagtgcaggaaagacgctacttttaattccggctccaccatatgaccttaagtaactctcacactctaaagccttaatctgcagtaaaacacaggatttcgtctacatcagaccttttgagtcttttggctgccatgacctccttggcagtctgatgaagcctgtgggctcattcttagcagaatgttttaaactacactggattacaaaggaaaccaattaccatgaatataggtatctcaaaataactttcaaagcaaacttgttgatagtaatatacataattctttattaataattaaaaacaagatatagtgcaggtctaatattcaccataattcggagtagtcataatcataaagacactttgagatatgaatcacaatggtaatgtgatatgaaactgtctgtgatttctattggtgacaacatcactgacactgctgaaactactgtcatttgttgcttacatgaataatgaaggaagtgctaaacttcagttagagattaatgaaacagtttttttctcaaccaaattttctgaattctgtccatttgtggttaagagccccagcctaggtaaataataaatccctttataattccattatctcagatcaatgattgcattgtgtccctggctccctccacagagaagattcacaaagagaaataaagcaattcctattctttccaactgtgtggagaaaaacagatttacaggatagaagtgtctttcctcatccctctccaagtgagggaaggaacacttattgacttggaaatgagttacccaaacactatcaagccctaccagcctacaggcaaatacataagaagtgacattaacaccaattaaccacagctcctgttccagccccacctgctcacacaggacctccagtccccttaaaaagtcccaactaagtatatctaggattccagcaagggagacttacaagagcccacaggcagtctgacagccagtcacaacaccatctgccatggcttctttcctgcaccagctccccctagcgtcctcaggaaggaacccctctgccgcctctgcagatggcgccctcagtaagaatcctaatgcccagttgcccccacagacagcagagtccatacttccaggaaagaggggtccttgtcatgggtcccacactttagaaagcctgcatatcacaaacaagcacaaataaattcactgaaaaatccacagcacctttatcataggcatccagatgtcctgtaaccctaaaccccgcgacaacggtttaagccccgagggaaatgcttctcttgcccaatctctttgcaccagtcaaagagtgactgagttggaatgccctgaaggttcgtggattgtgacattgcagtgtggagttagacatcatttccaaagcagagaagattcaagcagcattaatgcttaggtaaaagaaaagacttaagagtcatttctctcagatggtgtggacgcaacagattctcgcataacaagtgtaaccatgccaagcatccctttcctggtttctcttcgtgctctgatcagtggttctagaatcgttaataattagagcagcatttggaacaattgcacatggcacttgaagagtgtttcgcaattaaacaattcttattcttaaatttgtaaagatgtaacctgtatgaagcatgatgccaattctttacattagcaactaaaatggacactaaaaacaaacttgtgaatagttttgcttctgtaaaaacagctgaggatttaattcaatttcaaaaaaatattaaaaagcttcagcagcatttaaataattttgaattttaaatgttttattcattcattttaatatagatttatttacctttcagttttaacatgtgattttggatattttgtaagaaaaatcctttttttaaatagcttaatttaaaacatttttatacttattctaatttacatatatgatgaaaatatactaatattttgtatatgttgaatacaattacattacatgcttaaatcctttaggtcccgagaattagtacatgttgacaccttagtatatataattgcttttttggagttcaaaaacttaaaaagcagagatttttaagaagcagtagaaaatctgaaaagagtcagtctgtttaaattttaaagctgcaaataatgaaagtaagcagacttgtcaagcatgacccatataaaattcactaacaggacattagaaattatttatttaataaagatttaattactgttcaaaacaataaaaatgagccagaaaattattctagtcaaatccacaacgtgaactggtcagatgaaatccctgcaacttcatgttctgtgcaaataaagattttatcactgaccaaatgaagaatctttgtgggcctccatttgaactcttgccccagaggccccataaatactggcagcaatgaccctccccagctgtgtgttcgtaaggtccaaatcaagcttggcttataaccaattctccttcaagactgtcaccaaagcagttccatcaggttttttgcttccactcttcttcagaatctcacaaagtttatgcctaatacctcgtagccgtgtaacacaatggctcagatccagtcccagaggctagggaggcaacagttacacccttaattgaccaacttggaaatcttctgccccatctcagccagctacaaaaccatagctgaataccagtgagtgataacacatcttaggggtgagggaggggtggttctgcaatttgaaaccaataaagtccatacatttatagttcacacctctggagctggtagaaggcatttccctacccgacactaaaattcaggtcaagtaggaggaagaatggccacagaggccagagagaatgaaggaagattcagaaagtgccttttcacatttttgctcatgatccatttcttaaacttattggacaaatcttgtagcaagtttttttcttcctaacaatttacatgagcacaatgaacattttccatggagcctgcccttcacacttagaagcttagaggaaggatatttcctagacatctggattaagggactgactcccacagtaatccatatcagtatttgtttaaagatctctatggggtcttgattttcatgttttaaatagagaaataattttagaggttttgcagacacatactaaagtccaattacacacacacacacacacacacacacatcacatacccccaaaagcacgaggctgagtggtgaaacagtgaagggttgagttgcttgcccaagctctgcaagctattctatgaaattcagagcaagaacctcagtttcctgatgtttcaaccaatgacctttccagttaatcactgagccctcccaccacagctaaccactcacattgttgccatgatattgatattattcaatttagaaatctcttattaaggttttgataatattagaaaataaaacttagaaatcattaagctatcaagaatcattcttatattttatacattattataaaaatgtgtaaggtcaaacatatctgattttaatagacattacagaaattgtacagaacatttccaaacttaattctctaaggcatctcagagagtgtgactaaaaatgctatcgtgagttaaaaagatttaaaaatgtgttctccagaaaatgttaactaattgcatctgttctaaagaataattaaagtgccaataatgaatttaattaattaatttaaggtgccaaccttaaaataaaattgttttaattttttcagcagactttcaacatgcttcaaacatatgcacataaaaagggcatatgtaaaataaaaataataaatgattataatttaataaatttaaaataaagcaataaatatcttcaaataaatgaattaattatcttcatccactagtttgcttctatattctaagtaaaatcctaagtgaacagatcttccacgctaaacagaccaatcatgtttcttcagaaaacacaaatatcatatatctgatttagaaatttattttcaatatctgaaaagtatctaagctcgttaaaataaaatatatcttattacataattcttggtttaggagaaatttccgctatgtgtatgtttaaatagcttaagaataaaaacttacatcaagactcttaaaccaagcttgtcctttaataaaggataaattattacctgggaagggacatatcactacactcaggtttactgtgacctaagagattggcttaggtctccccagtctcaatggtccctcacaattccgaccatgatcactggttgaaatatcttgctagtgcttccaaaggtggaagatgtccccatattttggggaattccctgaggatatttacatgtacagatgaacaaacatactaaccctatctatcccaggtcttcccatagaaaaggagaaaatcagtctaataaaacattttaccacttcaattctcaaggaaaaggaatcccaatgttgtaataggtaaagcctgataagaatgcatggcaattttttcagaagctctgagaatttctactaccatgaacctgacagctagattgttgtattctagcaggctgagcacattttagggttctaaatggcagggaatagctttgtggggtagaaacattagtatataatactcacctcataaatgtaatttcaaacaagctgtctactcataaaacaggagagctgacttatattggctagtttcctataagaaggatgtattttatctaaaattttgcctgttttctctgctcagctatatctgtcagctgccggcctgggataaaacaggaattcagcaaacgtttgtggattgagtgatcaagtgaatggatgaatgagtgaatgaatgattgtaaacacgctcactctccatactcatgtacttttgtgcctttgtggggtttaggagcaattgcttcttcttccattctactactcctgttaatttctctcttgttattcctgttaaattataggatggtttgatacaatttaaaatacccctttgtaataatatgggtacctctgtgaaagttcttttatcaagcccggttggctatataattgcttgaaaaaacaaaaaccaactaaacataaccatgatataaatttcacccctttacattttataataataggctgttcatcttaacaaagcaatttctgaatttttctttaacaagctctattattattcctaaagtttcaattattaatagtatccctatcacctcctgctagcatattgcacccctgccctgtgtttcctcaggctgggtgtgacaaagtacgcctgcatatgactgtgtgttttgtctatgtactggcacataaatatccttgaggacaggaaaagaactggtgtatgtgtctgtgtgcgcgcacgcacgtgcacgcacttccctggattgttctccatggaaatctccctccagatgggaaaagagccaaggagagcccgaggacttccctgaccctaagccaagggtgtggcaagtgtgctcaccattatcagctggtgcccaaagggaaggagtgggaaggaggaaggaggtagcagggaggaggaggaaagctggtagtaagtgtggagatcttttaattgcaagaaaataatctgggagcctaacatttttgcagtattttaaagtgtgcaaagacttcacaggactagcacattctcaaatgacacctctaagaccaacccaagcataaagatcttctgaggcttatataaactttgcccattaaggagaagtcacagaaacagtgcaggcttttcctcactggtgtacttatgtactcaagataagtaataacctttagaatgttttcatcctgtgtttgctgtgttttcagctatatttctatactgaaacctcttcaaattcacacagcattcttaaattgccaaatccattggtcctttcttagatcacaacattggtgatgactttgcggcatgatacgctgaacactcccttaaatataaagctctaagctcaagatctgacataccctaggcactcaataagtaagagctactcttgtcagcgagctcctcctcccttagcttccttgagacttgcctctgttagttttccagctacatttctgacagttaaagtactttggaatcttttatctgatcttcaaagcccagacaaagtgttttcccccaataaacttccccacttttgcagtgtcagaattaatgccactctctcgtgttctcataatctttgctcaactctcattatctcactaatcatggcctgctttggattttagttgagctaatttttttttttcaagacagagtcttgctctcgcttaggctggagtgcagtagagcgatctcagctcactacaacctccaccttctgggttcaagccattctcctgcctcagcctccccagtagctgggatttcagccatatgccaccatgcttggctaatttttgtatttagagatggggtttcaccatgttggtcaggctggtctcgaactcctgacctcgtgatccacccgcctcggcctcccaaagtgctgggatgacaggtgtgagccactgcacctggcctgagaacatattttatatccccaactaaattttcagctacttgagaacaggaccattcttatttctctcaatactgagcacaatgtcttgcacatggctggctttccataaatgttggttgatttaaaagttgacaacagatattaaattgaatctttaactgcttcctgtttcccacctttcatagccaatcccaagccaaagcctatagaatattcatctacagtatctctcccaaaccctctttatattcctattatggtcatcctagttcagaactttactacctcttatggagactatcccaatagcttcctaatttgcctccctccaggttttccagttcttcttggtgatgccatctgtggtgagcagattaatctttcaaactataacccaatcatgtgattccttagctcaaaagtgggtaaagtttttctaatgcctaccaaactgatgtgctaattacattccagacgttctatactctctaggtctctcggttcctcccttcctcttctttcatgtctcctcttcgcttaccaatgttatgttccaaacataccatatgacttttccttccataatcaccccaactttatccatcccaacactttacgtaggtgaatatcattctcgccacctatcaaaaccttgcacatccttaaagctgtcctcaggaaatacttcctgctccccaagccctctacccaagcaaacccataagaaaattgatacgatttctttctcttcacaaaacattttatttatacatctctgaggaccctagtacaagttttcttatatccaagtcaggtatgtactagtccgatttctattttaggtagggtttataagcaacttgaaggctgaaatgcagacttactcatcattgtattcctccacagcaccaaaacactacattgcatatggcagaaatgccataaatattcattgagtttaaatgaactaaagcttttaaaaatagccaaaaaagctcaggttccatgtaagaagaatggggctcaagccaactgagtgttggcatctgtgatgattggtgtcctcaaaatttccacttaaggatgatgacagaatcaagctctgctacagccaatgaataatttatttgtgcacaaaacattctgttaatggaaatctttttatggctcaagatctaaaatgtatttactgccctatagttattaaatgtttgctttaatcattaggtacacaaggtaatgacaaatgataattacagtatcattatatactcttaaactgatttaatcaagagtatctcttctgaaattcaaaaactcctcagtggatggggatgggaaagattacactggaaccaatcaactcactgctaccatcaaatttaagaaactaaggttttctgttgttagaaataccaccaattgaaaaagtaactttagatacaaatgcctagtactttttttttaaagctcaattaaaaatccccctgcctccccgaactagactgcctcaatcaatgaaacacatcagagaaaaagagaagtgcatgtgtttgcgcgttccctagatgttccagcctgccaaaaaatgtttctttgctgtgctatttcagcaagtcgtgagatggcaatgatcaccctcctcaaaagaaaaagatagctatttttcctgtatgtttttattttaagaggctgggaggcacacttctggctgctgagagtactctgacacatacacatgttcctgaggaggtgaatttgtgggggaattttggcagggtgaaggttaagaaaacctaaaatcatcctaaactcttgggaaatatttaaggagctgaaaaaaaacagcaaaaagaggaagatgatgaagtcttccagtgaattcctgtttccaactataaaccctcatgaaaaacgaaaagtaaagtactataaaatacatgctttttatctatatttatatcagactcaactggtacacaatcaaattcatcacactactagacaaaccagcttctctctttacctcatgttttctattaaaagtgatattcaaactccaaagctcaaagcctggggtcatcactgaccgcttcctcctgctacccacccccagaatgcatgcacatccacacaagctcaccctagacccaatcaggcagcccctatgctggtgtcctgcatactttccttcatacagccagtgcctgtcaatccttatcactaccctccaaccagactctcacaccggtctgatctcccaccacacaaagtaggcaggagaccagcaagtactctgggtacaaatggcaaagtgccaaaggccagatccaggcctgatgcccttgcgtgcctgggatccagggacaattctcagaggcagtgaaccgtggaagggtcgagggtcctaagaaaaacaatttgagtggaacgcagccacaagggcaccatgatgcaaaacctgagaagtaaggagctgagggggatatgggaggaaatcagaaagaacttcctcagcctgggattcgagtctccactgaggtctgcgatgcagtgccttcatctgtgatgtaagcgtgggaggacatacagggcacaacatgagatgacagctcttgtttgaattcatggaagtgcctcctaagtggcttctatgcttgcagtgactgctgccccccaccccacctcacccgccatccaacagggcccagcccgacccatctccctgaagcgcagctctgagtgcagtgctctcctgctcaaaggttttcatgggcttcccacgcccctttgtcctgcagtcaatgtcagctgtgctttgccttcacactacacaggaatccctcatagtcagaggccacatgtaatttatctcattaaattttttcagaggtcaattatttttgttgccatagtcaaaacaaggagaatgagacctcctggtcagggactgtaggggtttttaggtttgttctgctgtgtggggaaggggtttgttactcttttactttaagagcaatttttgcactacaaaattcataaatttgtattcatgacctggctctggatatttaataggtatcagacttgcagattcatctcacaaatataattaaaattaaacctgtgtccaggtatcgattttcagtccccaaagtgaattttaaaacagaaacttggccaggtgcagtggctcacacctataatcacagcattttgggaggccaaggtgggtggatcacctgaggtcaggagttcaagaccagactggccaacatagtgaaactccatctctactaaaaatgcaaaaaatcagctgggcatggtggtgggtgcctgtataccagctactagggaggctgaggcaggagaatcgcttgaacccaggaggcacaggttgcagtgagccgagattgtgccactgcactccatcctgggcaacaagagtgaaattctgtctcaaaaaaaaaaaaaacagaaaacaaaaaacaaaaacaaacaaaaaaaacctcacaagcaattatttttattaaacccaacaaatatttattaaatgtctactattttttcaatcaccatttttaagaataaagaagacacaagcaatttacagtgcaggcatatgacaggaaaacttcacataaattactttattataaagtgcaagtacaaaaatgcatacaaaaagtggcatgagagaagtataaattgttaaggggtgatgcgggcaaaggagctcaaacatgaagagaagtaatactacaataaaattattaaccagactccgacgtcagtaaagtgcattaacccaaaatgcaaataatagatgaggtagaaaatgcgattaagaaagcgaatttttctcttggcaattcatgggtgagacatcaatgtgatatcagattcaaacataaaataaagatctctatgtgggggattttgtccaatatccaattaaaggatttatagtgaaaactgtaactgccaagggaaccggaactccagaggccattcttgatccacaagggatattgcttggaaatcatgagattctcagatcagggaagtgattgggtaaacttaacaattggtatcatcaggtttcagtttccagaaggtgataactgacagaggtctggaaaatttacagtccacatctttctacagcattttattccttggactacctcaagattccctaaaagtataagatttgactctgcccccagattttgatacggctggcttctatttctttatgtcagtcataataaaaagaacatagtggccacatccacaacgctccaacatttgaacactgccagttaactagactggtgacttggtagtgactgacatgttagccaaaaatgggagaaacagagttggattctggttctatgactcactagtgctgtgactttaagcaaattactcaactaaaaccaacccccccaccatgaagcctccggtcccttatacacaaaataaagtgtgagtaataactacataatagctattgcctcaaatgagataatgtacatggaagccatttgcagacagagagtaagtcattacacaaatattaattcatgccatcatagaaacaaggcatatgatcagtcactaagattcactgtgtaggttttgcatggagagtgaaaaatgagaggctccttcacacagccatcctatactgcaaactgaaggagacaggaaggatagacagaaggaaatactatgaaatgatatgaaagaagccttcagtcagggtttcagatggctgcagcatgcttgtggaacaaaatgggatttgctcatactactggtttagttaatacttactgatggaatgatgaatatgtgaatgaaaacttattaaatgcatgaacgaatgaaggtataaccaggtaaaatacttgaaaaacaaagcaggaagagtcaaattgtgaataagaaaaaataagaaaataattttggaaaaatgaagccatgtagctcaaataagctaacagtactgggctccactcacctaagctagaatagcaaaacaaagggcagtctttgtaaggaggccagaagaaatgtagagcatacataagagtccacattttcacatcagtttgtaaatattaatactcaaacataaatactgatagcctcttctgttatctcaaaatacaaggaaccaaacagaagacttgtatgcatctgaagagctataaaaatataaaaggaagtcctgtataataggaaacattttgaaggccacaatatactgaaacttaaaggtctactctgaatgatctgtgatagcagaagttatagtacacccggagataacagatagcaaatctaatttgcaaccttatcaaatcgttataagaccagctaaaaggtatccaaatagaatgaattaaaagggttttcttccttttcattttcctaattggtataagtaataataagaaaaaacatataaaggcatatcaaagagaaaggagagataaacagatgaagaaaaggtttggggaaatcacaaaatatagcaatttccacagaacacagaattatgtattttggacttcctaatttaaagtaagacttcagtgatgtctgactccagaaattactaacagtaataattgtataattatcagcaaattaattactgctctttaacccaatattttcaagtttatgagagtcttaataattttcaccttctttttttaggaaggaatatcacttacataattcctaaataaatatatccaatgtagtgacagcatataaatctgatcacccatgtgtttaaaagcccagactccagctaatatcactttaaaatgaataatgtcaagaccagtcaaaaacattcactgcttgaaggaaaatgccaggacatgcaaagcaatattattataaaaaataataataatttgtatgtactaacttttcaaaaagtaccataaaaggaagaatattgtgtggatgagaatgttcctttcttactttgcaaactgttttctatttactaccaatttgtggtgggaggagttgggcacatttttaaaatttattatttgtaaaaaaagttacattgaaaaaaaaaccctcatttgggctaatgcacagggccaggttcactgataaagtcactaagaggttgctgattatgtattccatatgcatcacgaaaatgcttaccgattccatatgaagtccttccttaccaaaagaagtatttgatttaattgagaaaatatacctagctctttgagtaaagaccatgttgacaggctaaagaatcagtcacgtgatagatgaaatataattctggttacatttaaccagtgactgcaatgactattacccctattaatcaccatcatcataaccactactgtgaactcctagtacctgccaggtatttaatcctcatagagccttatgaactaagcagcatccttatttaatgcaaaacaattgttacaaagcacagtgaccccaatgagctgactcaaccagaggagtccagaactcacagtgcaatacacaaggaggccatctgcactcaatgtccaggccatgtccattctcaggaggcactgataaaacagtcgcttgaacataatttaaattaggtaccaccaatttaaatgtcacttaacacttaggatactttggaaataactgtaaaagccaaacttgggagtagatggaaaattaaatgttgcaaataaagacatttaagttagtggttcagattattaatttcatcttctaacatttattatagctattgaaaaaattaaggctttgcttttcacacttttaaatatatgtcttcctaatgggtttttcatctaactgcctcatatccctttaattatccaaaactttttccaaacagcaccatgtgcccataacaatgaaaattattggtggcaaatgaagactgaaccatgaaccttacgggccaaatgaaaaggggtctctggaatgtccacacttgatatttctacactcactggatgctcaaaagctacactagcatatcaagttcttaggcagtggagattattttagacaaagggagattattttagacaaagcttagggcagttgttggcactacataaactacaacgctatcgctaaaaaaccacctgacatcatcttgtcttaagatgttcacaggtaaagcagacactattagtgggtttagtttagaagctgtcttcccagatgattagacactttcctctcttgttcgttatcagtcatcaggttttaaaatagctccagtttatttggaggaaaattaagtaacaagctgtacaattttagaatcatgaataacatttagaatttcagaaattcaaatcttgtgacctaaattaggaatacaatttttttttccaatttttctttactgtgtaaagggttaattaaagtatgagtttgcttggattttttaaaaaaattaccaagccctaaaatcagtatcatataaatttctgatgccaaaaatctgtttgacagagcaggctttactatactgacattttaacagtagccaaagtcctgttcccactaaattctgtcttggcagcaccaataatttgctaaaagcctaaactcctcctggtaactaatgtgttctcaacctcaggagctttccacagcagcacagtgcaacaaggaagctgaatccatcaagtccttccttaagatttctattcttattacagaaatcatgatttctataaaatgagaatggtttaaaatacagaaagatgctaatttacttcaaatgttcattacatcttagatgtgaatctgacaaaatgcaataaaactacatataaaaaccttattcaaagtaaaatctgatatttttacattacttcaagattataataagcaaatcatcattaatacatcaaataaaataatctggtttcgaactataaatgacaacattttctaatcttcagctaaaatcagacatttccagaaatgcaataaagtatgaatattttcatttagataatatccaaaacatctatcacaggtttcaagagcctcaaataattactgtcaaaatttcacataaagctcatttaatattgtgcttgaggaatctttccaataactttgaaatcaaaccatatagaaagcacttggcttgacttacctagtggctgtatgttaaagcatcggtaaaagagcattccaaccaaatcaattcacttaatttttcaagtagatctgattactatggtcttttaaaaaattcaaaggctccacctaatgagaaaaaaacaaagaactacatttaaaccggagcgtgattataggagctatacattaataacacaaaaatcaaatccagagtattatgatattatactatcttttcctacgttactgtgctacttaaagctatcaaacaacaaaagcgtctaggaattaagttaaattttccagtttggggtaaaatgaatgttcaagcatagagaaaacaataaaagaatacaacaaagtgtgagaacagaagagtttgttattggcaggtggaaataatggttatacaatgtcagttaagacattaaaattagagatgggggaaaatgcaatttattgctttggaattatactcattgattcttctaatttacttatgcaatgaaaatttgtaggtgacagttcctgaaagccattaagccctagctacatgcaatctctgttgagaaatagaaactaatatctagacagatcatttaaacataaaaatggtcaagaagtcttggagataattcactggcatggatttccaaatcattctgagaatgttacaccttgtctccacagaaagtgtttactctcctaaggactcacaaatagcttaattattatttataaataatattggtttattccattcactttgccagtagaaccacttttcctgaatttcaaacattaaattactatctcagctctaagagaaagtttgagagaaagcaagcattaacttaactagagagagagcctaaaatgaatgctagagggttgagcagaagagtgaaatagaaaattggacagtttctagctactcccaaattaggtcttcccaaggtagacttagtatgttcaaacatactaatatttcaaaaagtctctgaacatcaaacacaatcatattcaagtgaaagttcaaaaacttattccaaagccataagcacaagattttttaattgtgcaatttgaaattggccatgcactgccactcccccaaacccactaaccacattaacaaaattaattgataatctcagtattaaaaaataaaggttgaaacagatgttatccactagtattagaaggtagttgctccagaaaagaacaaaacaaaagatgttgctaacaatagagaagacaaatagcagtaactatacatactaactagaaatccatgtagtcatgggaaatatgttttcactttcaagaaaacctgtgtctagattctagtcttactgctattcaagaaacaattatttaggaaactcatttggacatggtctcaaaagacttcttcattaacagagataaataatctttattccagggttcttgccataaacatgacaagacaaatgtcaaatggtttggttatttaaaattacactgaatcaacaaacacaatcacctgaacaatgaactgcaaaatgattcaacacacacatttttcgcatttgaatatctagagcggcgaaaatatttctgtacttttcctaacattttatgcaaaagttacaaagcctctctcaaataatatttggtagctagcttcataataccacttctcaatacttcccaggatggtttcgtgcagaagctagcataacttttctttctgttagtcactttccaagaaagaggtagggcactcccttcaagatgcaggacaaacttcaagattcttaaaaatcctttctcattgatttctcgatgtacaatgtaaaactgacttacgcaaaagtctttttcagtccctcttcatttcttaggtagggtattgttttctaaaattatgtaattcttgcctcgtaagaggtcttccatttcctaagacaaccagtcattaagcaatatgttaaaaggtttttcacctgtattgcagcaactatgctctcatttctaactggttgtctaagtggtcagtgacttcaatctacttaggaatttttcagtgttcccatagagtacctaaaagtggtagtaatggacacctcatatcaaagttcaaaagcactaagtacaaaatatattagtcacccatatggatgattcagctaaatgactgtactgattagcccagaagaagcagatctgttgcctgtgcaacaggtaagcctcgcgtacaaaccacaatataatatttatttagaaatgttcacttccttaaaaataaccacatataatgaaaggaaaataaacacacgatggtaaatggcctacaatcgctacaccatacagcagtgcaacacctcaaataattttataacctgatgaaagtcactgactctaaacttccttacttttaatttgtttgtattgcctgccttaccaacctgggcaggggttgggggttgggggagggactcttagtgttttttggctctatcagaaaatctaaggacatctgacctttgtatttcagttatatgttacatggtctaaacaatggagcaatttatcattagctaatatttgatcatgcttgtcaccaattggtttgtttcagttattcgcatgtaataaatcagatgtacacacaatgctgggcttgagtgactttctctagctgagtggtctaccgggagtagtacacaggaaccatgctccctgagttcaccaggacactccctgggagcagttgaattgatcatactgttgcaatactgatcacagtaaatgagctttttgaggagccctctagagtagcaaccacactctcgagtaagcctgtgtatcataatgtctctatagacctaaataactcttttaatagtcatcaaacactctcctttcattgacaatgaaactgaagcccagaaggtcacttgcaaaaggtcatgcaactagaagcagttttcctgaatactattctactgttttcccctttgcatcgtagagccactgtgcctctcataggcaaaaattcaatcatggctagcaagagtttactgaacagcaactatgttaaacttgcttatcagcttaggatgggaaggaaaaggggagagtaatgagttcagagtgagagagaacagacctcaaataccacggtctccagagtacccccttcatcatggttacaatcaactcgtctcttcacaaacccagtggagaagtggccaattaaaatagggaaatcaagaataccttgacaagttatacgcccaagacatcttaactattttgtagggtttcaaagtgactcttgaaaagccctccccttgtggctaattagtacagctatccttatttatttttttttttttaatatttttttatttattttaatattaaatattttaatatttaatattttattaaaatattattattttaatatttttaatattatttttccttataaacacttaaaacattgatgacatttttaaccagaaaaacaccatttatcccattacccaaacacaatcttttcatttttaaaaattttaatctattatttgtccccatgtaagcatattttcactgagatgtcctcataatgcacatataattgtgtattctgattttttaatttaacatttcgtaagtatgttatttccatgaaattcagttttcatttttactagccatatgatattccataaagctaacataaagtcatttccttcatcattcctatatgtggcaacatttcaaatgttctcactaattttcagtaccaccaatactgttttttcttagaatattctcaaaaataggattatcaaattgaaaggcaaaaatatgtttataatggacttcatatttatggccatattgatttcaagagattgaaattatctacaaagccaccagcagtagatgtgcattctactttcaccaaacttcctcaccattgcatgtaattaaaatttcttttcagaggcttatttaatgtaatatgatatttaagggtgtcatttttattttaatggtgaccataattattctcttatttaaaaattattttattgtctttcacctctaatataaaatgtatctactcacataatttgactacctttaggtcatagttcttcttatgaacttaaatgaccctttatgtaatatatattaattttttatacattttttcctgtaaatttgttttaaccatttaatatatcaggcatatatttagatccatagcataaggtatgtattcagatagttctgaccaattccaaattatccataatactatttactaagttttccttcctcacacatctttctataagcttgctttattatgttgtattataatttgtctatttctgggctcaccctttagttacatcaatccacatatttaaaatggaacttttgttcagactgccagtatgatgtgactggcattgtgttaggtcgttttcatgtgcataatcacatgaactttgtgtgtgtgtgtgttagttttaattactgttgtttcgtagtatgttcaaatccatggtagagctagaaactactcttcattttcttttttcaaatgttcatcgatattttcttttctgcatgagtatatgtgggaaattttcacccattttttcagattatattatttaattaagtgtactgtttgccctccatattcagtcatactcagaatattcccattagcagtctgattaaaattgagttgaattatatacatatgcatcttttcaacattttgttgtcccatgtttaaaaaaattgcatattattatgaatctctacatatacgacattttaacatttatattcaatagacatttatattctgcaagtctcctgattctctgtctttcctcatttccatttcacttgcttggaaatacttcattcttcatgtccagcaattaaattgtgtgaattcctcacaaggttccctaaatcacttcctttacatgccggaaaatgctgattaaatagaagacaagtacttaaaatcctatcttaaataaaatatcttcatttccttgaccaaaatgaaattaaaactgcatgtaaacaatatcaccaccacaaaataatatctcatgtaaccattctattccttagaatatttacatgacaaagccctgagttcctttaaaacacagctgaatggcttcagctagctagagccctcctccttcccttccacccaccattgtctcttatttctgctatctgtgaaacagttctgagttcaaagatagagaaaaagtgcagaaatacaaatcacttaaaattataaataaaatatgttaaacctaagtttgactgaaaatagtctaaattttgttgtgcatgttaactaaatccacgtgttatcttccttgatttcacaaagctaggtactctcaaggaatcttatggtttacataaccgatatggtacatgaagaattctagactctgtactgaaagggaagagaaggacaaaaagaaaaaatgggaagaaaaaaaagacctgaacgtctgtgtgtagataggcaaataagaactgaaactgtttgccatccgcactttgaaagtcacactatgtgtcaagtttgtcaagtcgagtgaaagaaggagtgatgtgcttctccactttcctgaagaaccacgtagaaaatgtggcaaatatttaatttaagccttgtttcctgaaagactgcaagatgcccacaaattttctttcccagagttcaaaatagcaagctgagtgggtgtaagcactttaagtgaaaaaaaaaaagtaactaaggaaaaggaaatcgtactttctgcttcttagtataagatttttttttaaaggccatttaaagagatattagtgattaggatctggtggttgtcttgaatcagaatacaaatacagtcctggtgacctcagacagagccccctggccacatttaaacatgattcattctgtgtaaagatgaaactgacaacatcgtagttacagtaagagcaagctgttgtctgctacgatcagatacctaaatcacaacaggaaaacacttgcacgaagggaaagctgaatgtctatagggcctctaccctttcccaagagagggaccttcctcagcagtgctttataatattttcacatgtagatgagtcaccaggggagcttgttaaaaatatgggttctgattccgaaagtctacgtggaaccccaaagttcccaggtgataagttcgctggtctacactttgagaagcaagactgtagtctgtaacaatagtttcctaatagccagacaccagaaatcacaatcaaccaattaagaacacttactagttacctgtgccagttgttataataaagtacataacaggtgactgagctaatacagaaaaaaagtatgttttaaaaaaataaaagctaaatgtgtgaaaaagactctaaggataataggagttgagaacaggaagagttctgtggggactagagtggtcgcaaatggcttcatagagcaagctggacgtgtgcagccccaagttaagggaaggggtggatgtagagaaagaaagagcaggccaccactaagggcaattctagaagggagagcctagagttcccacaagagaaagctacggtgagcctgctttgtggttatagatattatcattggaagcttttaatcagaattcactttgaaccaggtgaaaggaaactctggccttgtttaaaatttgtcggtttggaaattataattctattccaggacaggaaagaatgggtagttttgccttagtcttatgcaaattttctccattggcagcagcaatagtgttatgaatgacattttaggtttgagcctgggagcacaaaattaccatttttgtacatatatttatgcatatgtatgcctttggttaacatatgtctttaatgattaagactttcagagcattagaatcataacttttcactacaatagatttaataatcttctgttacttcgagtacttgaattttacttttattataaaaagaatttttttctcctgtaacatactttcggatggcacatacccacacaacaccctcaactccagcaatattcttccattcttctctttcctcccacactggctgacaatgggaagaaaacatatccagaaacagaatgaaattattaatgaattataccttatgtgttttttttaatcttaaaagagtttttcctaccaacccacaatacgttgggtattgcacaatggattcaacagaaaagcaactgaggattccacaggtcaatacaaacataaacattcaatctctaaactttttttttttaatgaagagaattgcagagggatgagcatacttgcaagctgcaagaaggaagtatttgaaagagaaacctaatattttagctctcctaagtcaggtcagtaatctcactgagttctatttccatcttttcatcttgggaactatgaaattcgtcatcttattgtaagcattaagaaatggtacttggaagacttacaaatcttatgtttcacattaatgttaaatgccatgactatggtttagccacagttactgtccgaggtatgtttctctcctaccaaacttcactatgcttcctgttcttagtaaggaagtcagaatttaggcaatgaattacggcaaaactgctatttcaaagcatcaaggcttgaatgttaacaagatacctgtaacactgcgattgggccgaacaagatcctagtattcaggatgtaccaacagagtcaccttccctcccgtcaatccaatgcacacacacatgcaaacactcactagtgacaagaaaaaaaatattaatatgagaatgctaaattactgctacttatgaatggttacaaaaacaataaacacatatgaatggttgcaaaaacaataaacaaaatgcaaacaggcacaccctagtgagaccacgaagtgtgtcttctacaaatctcttcccctttctatcctggtcctgttcaggtgacctggcctaacctggacatggggtctttgcaggctgcacgctgcatctactgcagaaaagagctggtaagatttttcatgctaggttgtcaaaaatgtaacgtgttctcattatgaaaacatttacattaagaaaacagcaaaaacaaacaaaaatcttgggacatcatgaaacttaatacaaacaaataactgttggtgaagagacagatttgggggaggggttttgcaagaatagaagcaagacttcctcctctgtgggaaatattagtaatcctattaaggcacagtgcaaggtgtgtcatagacactagaagcagatatggtttactttcagttctctgaggtgattcttattggaattgaagtggctcttctgaaaacaattaatcaacaataagttctctctccctccctctctctctttctctcttcaaagtgtgtgtgtgtatatatacgtatgtcttttgactaattattaggcgtagtcccatttttttctccttggtacctatcactataatcatctgtgtttctgtgtcacctgcttttagaattacacatggatattaccagaagttacagagttaaatttgcaacagcacagacttctaactacaagcctgggaccatggtggaaacaaaggttcagttaaggaagatttcccgagccagaattgatgtcctcactaaccaggctgccaggcttaaatcaaatgaaggtcgatgcaatgtccccagaggaagctgttcaactcgccgggtcggttccccagagccctgccaaggaggctcctcagattgacagcgccctggcagagctgctgtcttccccaggcagagaggccctcccccggacaacaagctgggtgcaaactcgtcttccgcagacaccaaaagagagcacagcaaagctaagcgactggggacagccacttgtggctgagacaaaggcaggctccccctgccgcaggacgatcactaggactgtcaggctgtcgaaatgtatattgcagacaggacatccctcctggcatccagtgtgagcgaagtccaggccacggcaacaacagcctggcctgaggacagcctgcaccacacatcaaagccagaggccctgggaggctggccagccgccaaagacgcctgagagcggcaggggagtgtgttgccttaggacaatagcaaactgggacgtggtagagtctgtaaattccaagcactggggaggtcttctcagagattttaccctctcctgtcagggctgtgatttaatttcctttgaagaaaaaaaaaaagaaaaaagaaaagaatatacattcccaaatcttctgtctgcaaaggcagacaccacaacgcaagcttaatgcactctggtccttcccggccagcggccactgtctaacacaatacagctaagtgagatgtgacattctcccggtccccttaatagggcattaagtctaaggagtacttaagatcatttaaatgcaaacatcattgttccattgctactagactcccagatatttcccatcaattctgtttaattagagtagcaccacacgttaattataacctgacagttttattgatttcacagggcacatcatacagtcccattttaggtaccaaggacttaaggtgaagcatgaacctctcagtcacaaagatgactcagcctcttgggctgatgaggttctgattcttctaccaggagaggtttacccacttgctcaacagaaatagttcagtaatcatcttatgtcctcacttatttcacagcgttttgcaaaacaacacatcaaaaacaaactaaggaaaaaaaaacctgtaagagtgtaaaagaaatatccatctccctctgttctgtggtcttaatctgcaattcttaaggaccaggatgaggtgctgtgaaggctacgcaggtaaagctggcaccaaacagaaatatggtgcacttctgcccctgaagcgactggccccactttgagaagccatgctgtaaacatgctcattagaacagagaggactggtcagttttcctttcagaggaaatgaatatgagttgagatcactcaactctaatccaccctgtacctcagggttatactcccagcagcacatgctccactaagccagcagtttgtcatagcccagcgtgtcatccataatggcatgttgggggtggaatcacttccaattcctcactaatctggtgcggggaatgccaaggtacagagttttacttgattgcataaaacatagagctattttcagcttccaaatcatcgttctggctctttcaccagtcctaaagccatattacaaccctttaaaaacatcttttctattcggttttcccttattttaatataagcaaacacttaaagtaatcccactaagtctctgaaatatgaagccatgaaatgttagaaaaaaaaaagacgaaaaagagtttaagagttttacacatatttgcgatttaaaatggtcactgctgctatggtagtgggacttgagttatctccaaactccttataaaaaccctgggcaattaacacttagcaggacttcggtgcctgatgacaaaatcaattctgttatagtcacacttcgaaaaatgactttgaagagtaacaataaataatgaaaattaaacaactgctaactgatataggaagaacttcagctatttctgtaataattccactgggatttgtgctgaacattataaaaacaggatgttttgtttgttgttcttcataaaagactactgaaccagtataagactccaaaatatatgaagactacaaatctacatgaagtctactaatattaaaaaaaagctaagtggaatttttattcatgtatttaacatttttgctcaatgtaagatgacctcaggaaacatgtttcttatttttatgaaagccaaaaggaaacacagttatataacataattctgcaatggttcagcatcacagtgcagagaacttaatcctaaatataggactgtcacaaatcagtcttcactgctaagacttcttatatttaacattaacaacggattatcccatggtaaccagatacctgttccatttagttagaggctaatcctaacaacataaggattccaatagcaaacttttttctaatgttaccatcaatgaactgtgatgaagctactgcaccaagaatgaacttaatattagtggatttagagataacttaaagtggtatgattagcacacaaatacagtcttatctatggatgtgggatgggggaaggtatcacttctgtaaatgaaaccattattttttactgcttaagtaaatgaaaacattcatatcctcttttcctgacacacacagctgtatttggaagtgtagaagaaatagggaggaagtatgtttaggaaagaattgcacctgaatattttcctaaaggctgggcatggtagctcacatctgtaatctcagcactttgggaagccaaggtgggaagattgtctgagcccaggagttcaagaccagcctgagcaacatagtgagactctgtctctaaaaataaaaattaaaaaaaaattcaactggagcatggtgcacctgcagtcccagatactcaggtggctgaggtgggaggattgcttgcatctgggaagttaagattgcagtgagctgtgattgtgccactgcactccagcctgggcaacagatccaaacactgtctcaaaaaaaaaaaaatctgaaacaaatagttgggctctgctctgtccattctgatgcttttgaaatagctggaaaagtcacccaaataactgctgctgccattccatgaactgatctctatttaaatcaagtgaaagcaccagttcaaccccaagtctatgaaaggaactagaggcttctcttcacttctgaggtcccagaggctacatctaatcactaagcctgattgttttattttctgtaacactctaaaaagtatctttttaatatctaaccacttatacacttttctacctggtgaaatctattttttcctatttcaatatctataatttgctatttatgtcatctgttaacctattcaacaatcatttaccatgcacctatcacacaccaggcactgggctgtatgcaaaggtacacaaatgtgttttatgatcttagagaataccgggcttggaggaagtatgaaaagtgctgtagtacaaattaccacagagtccataggaaagagaggaggagttattaaggaagctctgacagtggagacacttgcagtggatcttcagtaatcagtagacatttgtgaggcggaaaagaggaaaaccaagctgaaaggaaatatattcggttttagagcaaactaagtttgaggtgccttagaaacaactgggtagaaatgtccaagtagacatttggatacatagatgtagaatccatgggaatatgtgaactgaaaaactagtattgaagactattagcatcattagcagctagagtgattctttatttatttatttttttttttttttgagacaaggtcttgctctatcacccaggctgcagtgcagtggcacgatcaaggctcattgcagccttgacctcccaggcttaagccatcctcccacctcagcctcctgagcagctgggaccacaggtgtgtgctgccacacctggctaatgttttttgtatttttttgtagagacagggtttcactatgttgcccaggctggtctcaaactcctgggctcaagtgatctgattgccttggcctccctaagtgctgggactacaggtatgagccaccacgcctggcctagagtgggtttctgtaaaacagtctgaaaagctacagagagtggcttaagggttgaactttgggaaaagcctcaaagactaggaagtgtgcaaaggggctgagaacagagacaggcctactaagccacagcatcacagaaccaagtggcgaaaaaattaaatgataaacagagtcagacacaaatcaggtcaaataagtcaaagacccaaaagatgtcactgaatttcaaaattaagaggttataaatgttcctcgtgaaagcaggtggtcgaaactgtgaagcagttgggacaggtaaagtagtagctagaaaagccatcaggattattggttttattgtttgcttgttttcaagatggaagggattggagcatatttaaatttttctagttgagagacctttaacagctatggccctgaaaaaaaatacaatgtcctaacaatattttactggattaaattttggccacagtggagagataattatgacttgattgtgttaatataaaagttcaaattctcagcaattgactactaatgatgatataatgatttggggagtctttaattgaaggaatatgctgctgttctgtcgaataaatcaataaggaatcgcataacactgtggggaaatcttgaaaatgaaactactaaaagataaactttgaccatataattttcaagctgaacaaagctttagagatcatccacttaaatctcttattgtgaaacagatttaaaatcaatgcaataataacaacttccactgaaaaatatcaaaactaagtttaaattgtgcaagaaagaaaatgattatgacaaagaggctgcccaaactactctgagaaacttttaaacattttattcagacatctagatgggagggaattcctaagcctgacaattataagttatcagtaagtccacctagacaatttctgaagaagcaccctgaaagaattcactgactgctcacgctcctagcacataatgactaattcatcctgctccatctggggtcatacctcaccgtggttctcaccctgaacactgtcgcaggacaagaaaacagtcactttgaaaatagtaagcaagaaacccaactgaaaaatgttagttttacagtctggtggtttgtgttgtatgatcataatggaaaacccagttttattcatgtgatgaaaaattcaggaaaaaaagtgtttctttataacttaggaaatgacttctagatggttagtttctgggaaatatacaaataatagaagcactttcatattctttcataagttgaatttagagttttccaactcccttaagaggtgagaaggaaaagcaacaacaagaggaagcaactgtagccagcctggaatcaataaggcctagtaataggatttggctcatagccaagagtggggtccacctgctttcactgtggtaagactcagggttgaggctcttttatatacagacacacaggtacaccccaagcatgatttaatttctctataagatgtagcaaatagttttggcaaactagactctttaggctgctatgatttccacaaagaggaatgttaaaagtttgggctgactactgaaaaccttaaggaaatgaaagatctagaaacggtaatggagtttgaaacaatcatcacagagaaaaataaaagaaagcaacatttactgagtattttcccatttaatcttttatgaggcaggtacaattattaccctagcttacaaaggacttgaggccccgaaaggctcaggaacttgtctacagcctcactgtaagtgctggagagagttttttaatcctttaagcctgagtctgaaccatccctcttgaaaatagacatagtggcaatgtaaaaagatacatgggttgaagaaatctaaatatcctgccatgactggcactcaattttcagttctagtcataatgattctgacctgacaaaaggatcaccatgccaaaagaatgtttaatgtattgaaccattcctgattactcactatttgagctggtatgacagaacctcacggtggaagagtttcagtggggttcactcatgtctttatacaacaatgatatgctgctttcacacttagaacgaaggtcattgctttaaatttggcaagaaaatcaaagtctttcttatccagctcaagagcattattttacccagatcattgtcctaatttactttggcaataaaaagtgtttattactataaagtaaggctaaaattgatgggtttgggagactttacacaccatgttccactaggttaattttggagggcatgccatgctttctatctttaaaaagtatagtctatttcttccttcttaaagccacagatttcccaccaaacttaaaacttcagtccattatattattttaaattttgttttaactttattattgggaaatgactttatttaatctttctatcaagaagtagcatttcgctttttttaataaaatgctcacaataaactctttttttctctcatttattcaattatttattcaacaaacaattgtgcattcccataagccatgattcttgtcttcatggagctcaggggctagtgaaggtcagacactgaaaatagattgttactgtgtggaccccataacaaaaggcatgctgaataatcaattacataacaatatttgagaaaggcagcactcttctaaattctttaaaacttgggagctaagtatccctcctatcatgacctgaaatatagagtaattcttaaatccaccacagatatactttatttcaacaactcccagatgtctcaggacaccctgaacccagtttcaaaactcatcagcatagatgttttagagatttctccaaagaagtcactggcccatcactatcacattctagtttaggtagacttaacactcaatctaatgaatcaatttgtgcagtttgacaaatttagagtaacaggggaaaaatacataagatactcagaactggaaaaccctctgagtattagagtcttctgtgttgtatctttcctagtctaaaatgataaacattcctatctttgaaaaatttgatataaatatttgtcatttgatgtagaaagtgaggtatttttgtgcttatcttttaattactccaaacttctcttagtttaattgcatacttgtacaacatatacctcttttcttactttttctagaacctgctaagattccagttattttcttattgacttccttcagttggtagctagatccatagattaaggtatttttcttttcctctcttggcagattaagttcatttggcacagatttgtacacaagatcatgtccaaaaggaatccaaggaaattaccagatatctatttttttttccacatcagagaagcaaaccctagctaatccagcttgtctgccctctgagcctggggcttagtgtgagaagttacactcccagtagagaagggactctaagctggctacccaaagggtctccctgtggtttcgataagaattcacttgtaacaggtgctagcacctgttcttccggctcccagaatagttcctacttaaaatgaatcatactctaacagttcacttttaagcttactatttgaaatttggaatgtgtttccctctaaaaccagtgtcataaatactggttggcatgcaaggccacccttcaaaagcctgtataacctgatttagaattcgcctaaggcaatgtaataagagcaacatagaacctacccaccttagatggcatagcttcttgtcaaatagtcacactgagaaattgagtcaataggatatgaaactgccttttcctacaaggaccgtaaaagtctaggtgaaactctaagaggtaaataacaaagtaagaatagcaagacacagatgggccaggggcatcagtaggaagaatctcagtggctcttgtcttttgtcagggcagcagtggtggtccaggcattggtagcagcagagatggcagaagaatggaaaagaaaagagggcagggaaaataagtgaatcagaagctagagcagcctttgaaaagggagtgtcctagaattgagggcaagagaattgaggaagagaagggaattcctaccacaaggcaaccggggaattccctggttggggttgccattcactctgtcactgactgggaatattcactgtttagtcacataatgttctcagtctttgtttcttactctggtttcttaaattcaagctctgtgttgttcataaaaacccggttcaggctggtggctgtgccatccccctcagatttattgttagcctgtggtagttctcaattagggtgattctgcccccttaagagacactaggcaatgtctgggagttctttctggttgccaagactgggagtgggaaggggtatgctattgtaccctggtgggtagaggccagggatgctggtaagtattctacaatgcacaggatagtcgcccacaacaaagacttatctggctccaaatgcctaaccatgctggagctaagaaaaccggtaacattgtaactctgctgcaataactttttggtacatgtcactaggctcctgatgtttaagcaagtgattataacaaaaatcctttagactaattgtattactcaaacttcatcctaaagatcgtgctcaaccaagagaaattctacaaaaaaacccatagtattcttcagaattacaaagtgtgacatttgttttttaattgaagatgtccaatcaagacagccgaactttaggaggctggcagaaagggcacgggatgaacttggtatcacctgaatgtaactgaaattttccagggaaggcactgcacaaactcctctgtgaatgtgaaccctgccaccaatgccacatcctgcttcttaagcttttccataaacagcagctgtattcctccccaagcatcaaatgacaacccaggaacatgcacacgttcctgaaatgctcgcagccacccagtattaaagcaataatctcccccagggaaaagtcctactgggccggatgtaggaaaaagaatgaaagcaggcacagctttcaggtccactccaccacaaatgactccatgacccgggcaaggaacgttaagtaacttctttctggtcctttttttcctcaactaaaagcagaaaaagtttggcttagtcatctgcaacttcactttcagttctcaccaccatgctggttttcttcccaaaaggtaaagagaagggaattggctccaaagaaagtaggtaagagggagcttatgaaacccgcttcattaagggtcccagtcacatggagtgtctgtgggctacaatagatgaaccacccacgtggtaagttcacccacaagagcaacttttttgaacacaggcaaaagctgaccccaagcttgataggcgaagtctccactgagctccaggccacatgagaaatgctgactgtgaggatgaaggaccaatctttgtgtgtgcacagcagggaaaggactaatcattccacactggcctcttccgctacaaccttctgtacaagtaaccgtcatccccagagcaccatcttatcattaggaaggacagaagaagaagagtacagtgtgttttaaactgtctttgtgttataataaaaatcacaaacaaaaacaaaatgggcacaaacagtatgaatttgaggagcctttaattttaatgggcaaatacttaatgtattaataaccacgtggtagaaaccaaaattagttctggggaacctctcaactatactgaattatctgctgagataggttttgttcatggatctacaataagaaaggaatctgttttcctgagtctccccactgagttttttatgcagtgcttctgttcatatgcttaagtgagccatttaaaaggaagagtgtcaacgttggactcaggctttactggtatgaaagtgtaaaattatatttgtatccacagatttccaaaatctcagtatgcaaacttattaaaaatacactatggtggaggcatatataagaagtgaaagtattctttcacttatttcttattactgccagttcaacattatcacaagctcacagggctatgttttcccaactgaaacaccaggatgttaatgtgtctgaaatttgagaccttctgataaattatgcttgtttgctggttttgttgttttttggtgtgtttgttttcagtaaaagctggcactttataaaatatctgtcttcagtatttgacaacgcttgacaaccattctctcgttactttttaccacatcctggtaagggggaaatggcaggtaactgcatcgcttttcactaaaaaacagacagcaaggggttaaaaaaaaaaagaaaaggagaatttatgtctcccagttccacctactgcaccactttaatatccaggattctccccaagccattcccagagaaaaaagtgaaaagaatctcctttgacttgcttgggtcactgcccccaagacactgaagactcaaagatactgaagacttcaatgtacaatacattggtggtgaaactaaaagtcatatgcaaggagttgactcccctctcactgcaaataattctaacatgaccgatgtgctacagaaatcaatagcagtaatgactaccttttttggaactgcctcagcagtcagctggagagggggccttgctaagcccaggcacactgcctggatcaagcactgaaatcaagcttcacaaaagagaagcgtgagtaatttacttattaaagagataactgtaaagtctgatacaaacagacaagcgtaaagccttcaatgcacaaaccaaatgcttggcttggagaccataaaatgcaatcagcaatgaaatctaggttatatcactcaactttcaaaagtctaatgcccctttttatccttagaaagatgacacaaagaaatgacctgtgagggagacttctggttagcaggggctccccaaagacactgagcccacagcaggaagtggaggggaaacctcagtgactggtccgagaccaacctggacttccgtgtaaggtacaatgcagataaaggggattactgtacttcaagtgggttctgaagcattctacattattcaaaaggacaaaaatctagtcaggtgttgcccaaatggtctcctctgtgatcatttttctcatgttgttcagaaacgtagtggtgatagtgcatttgtgagactctgtggccaggaaacaacatctctgtaaccccaattttaaaatcatgacttcactgtcaccaaccagcgaatgccaaaaataaaaaggtagaaacatctaaaacgctgttagaaagtgaagcttgagttcatgagcaaattagaaaaaaaaaaaaagtcatttgccatcagatgttgtctgtcaacttaaaaaaaaatccaaataaaaagagaattcaaacagttcttctacaataagctattgtatagcccctagatctaagtcattcacaactcccggaaataactgcatattcgccaaatgctcttattttgtatgttctcacggggtttcaggacttgtgcaaattgttttccaagcaccatccggccataatgaccaggttagaactgataattatgcctgcctgtctataggtttgtcagctaaagaaatccacagacggctgcatcatgagcagaattctacttcgggtgcagctgcgctgaccacactgcattagaaaaacaaccctctttgcaataaccagttttgggcatcactggttaaaaaagactagtttcctgtttttctccaaaacttcagagtgtgggtattgctattttttaccccacccacacatttttctttttaattgttgaagattaggtgctgtaaacacctaatcatgagcatttctttatattaaaactccaggtttaattttaggtcggatttgttctttccacacggggactcccctttgttaagacttgtgtggcttctcctgcgggcggggggaagccacggggctgcgggctgctgtctaggaggggctggggtcgggtcttgggtctgggaacttatctatggcccagtgttgccccaggcagctgtcccccaccattggcttcctgatggcccagctatgcatggtccccggcagggatgctgcagctgacctagggcgacaggtggttgggggaagagaggctgttccccctagaagagtatctcaacccaggcttgggaaacagcccttactgatgaaggctgggggactaacagtgacataaagcatcaagatcccagacatatcatcttatttctgtttatactatgccgtttctcttcctcactttgacatgttatttcctttctttcaagaggagtttgaagtatatgaaggcagtgcacactgtagcagggctgctcctggtgcctgaccccctcacttcactctggcccctctgcaaatgtcacctccttgcagatcccccctctcccctacctaattaacacacaggcatgagtgctgggcaggatgataaatatctgtctcccacactgaatagaagctctcaaaggaggcagcactgctctgttcactcctatagccccagtatcctaaacagtgcctggaaaataacaagtgtttgattaatatttcttgagaataaatgcccccctcccttatctgcttcatcttttatcacacctcctctcacctgccctcttatttttttattttttaattaaataaatttttttttgagatggagtttcactctcgttgcccaggctggagtgcaatgacacgatctcggctcactgcaacctctgcttcccaggttcaagcaattctcctgcctcagcctcccaagtagctgggattacaggtgcccaccgctacgcctggctgatttttttgtatttttagtagacacggggtttcaccatgttggccaggctggtctcaaactcctgacctccagtgatccacccactttgacctcccaaagtgctgggattacaggtgtgagccaccctgcccagccctctcacctgatctcttgggcccacctctctggaaaccctcatttactatactgcagtttgtttacatatgccttttttataaaccataaactcgtggagcttgaggactgggctcagcacacctggcacataacaagtgctcaataaacatttgatgggtgttgttaaatgaatcatttgagattagccactttgaaggcaggaactatgtagatactgtagaaacacattctgtctctattttttttaaccaatactataacttttgatccctacaagaaaagtctgaggcatttcctcagccaacagtatatgcttaaaggcatagcaataagacttactctgggaggatcacttgagcccaggagttcgagaccagcctgggcaacaaagggagactccgtctctacaaaaaattaaaaaatgtgtgatggcacatgcctgtagtccttgctatttgggaggctgagatgggaggatcacttcagcccaggaggtcggggctgcagtgagctatgatcctgccattgcactccagcctgggcaacagagcaagacccagtctcaaaaaaaaaaaaagaaagaaagaaagaaaagaatccacataagcttgtcgaaacaaagactagagaaataaaaacttaaaacgataaatgaggcaggacgcggtggctcatgtcagtaatcccagcactttgggaggccaaggtgggtggatcatctgaggtcaggagctcaagaccagtctggctaacatggcgaaacactgtctctactaaaagtaaaaaaattagccgggcatggtggtgcacacctgtaatcctagctacttgggaggctgaggcaagagaatcacttgaacctgggaggcagatgttgcagtgagtcaagatcacaccattgcactccagtctgggcaataagagtgaaactccgtctcaaaaaaaaaaaaaaaaaaaaggaaagaaagaaagaaaaagaaaaaaaagaaaagaaaatgataaaagaagtgtttatcactgtactgctatgcaagaagttgaggtaatatcctttgaaagttcctgaaaagaaagaattctaagcaaaatcaaaatcttcatttttgttaaagttcacagtagggaaagtgttaaatctttttttctcctgtaagttctcctcttaaaggaaagacagaaattcagcaaagatctctatcccctcggacctccaacatttttctgaactgtaaaaaagataagaaaaaaactgagccacaatcacccttgtatgttatgtacatgtattgacttcatattgctcccattcatgttaagaagaacccaggtgataaaaacttaaatgaactcctgatgaaaggaaaatatatgtatattttatcatttgtttcaagaatttaaataaattattaatatgtacattcatactataaagctctacaacagtggtccccaaccttttgggcaccagggactggtttcgtggaagacaatttttccatggactggcggcaggcagggggttgggaagactgaagtgcactgcatgtattgtacactttatttctattattagtacactgtaataatgaaataattttacaactcaccataatatagaatctgtgggagccctgagcttgttttcctgcaggaaaactagatggtcctatctgggggtgatgggagacagtgacagatcatcatgcattagattctctttgggcaagagacctagatccctggcatgcgcagttcacaatagggttcacgcttctgtgagaatctcatgccactgctgatatgacaggaggcggagctcaagtggtaatgctcgctcacctccacttacctcctgctgtgcagcagttcctaacagccaacagaccactagtgatccgtagcccaggtactgggacccctgctttacaggctatccattgctgcacaaattttgtagtagctttattccgcacaaattctgcaacttgtctaagcaatagactttttaaaatgagaggaagcttctttaattcccatgtgccttatttaatgttggaaaaactaaaaaagaaagagaagttaagtcaactatcatttcacagaagacacagatctattttcaaggaagttaaaatctactcagacagtatacgaacatgcatacatcagatagcagaaacatcacaacagaacgacatgccagcaagtaacacctgaagacaatactctcagcatattcaaatgctgaggctcattcacaaaggaaaatgcaggctagaataatagacctctttggttctgtacgtttctaaataacataatcattgtcttatatattattaccaagtagcagtctttccccattcattgacaaatcaattggaatggccttcccctgtatgattcatacataaaatgaaatttactaataatgagaagttttgacataggtactaatggcttgagatgaataaaccagatttttatatatgaaaaacatattgtctcctcccatggaaaccagagctgtgaggcaataacattggaggaactataagcaaaatgccagagcaaagaagtaattctattacttgaaggtatccttggatacagtagaatagcaccatatactaacagaatttattttaaacccacatacacatttttcccatccgactgttggtaaaaggtaatgagtatgaaacagtaatatcccaaatttaacactccaaaagaatctgtttgggctttctttccaaatcatcaagtaaatgcccttaaaatttgccctctccctccaaacaatttaatgtcatctaagttcaaagttgtcagtcccacactttcaaattataaatagataaaactcagtgtatggaacttctgtttagaaaaggattccatttcaaagcgggctcctaagaaagaaatggtaggtaagcacaccagtccgggtggaagccttactagagattagaatttggcccacctgcaagaacagatggctattctggacagctgcaggaagatgggggaaatagcttgagggctactgattgctgtaataattaaaaccaacaacaatgacaaagtggcacttgaagttttataccgttacttaaattttttttcagggaaatttaggcttataaagttagagtggcacatcagcccagcagtttgttaagactctattatcaatcttttatactggaatctgttagcagccctgcattctctttttacactgtagagaataaacattaatacccaaaacgtgtgtttgactaacatatttacaagaataaagcaatgtattgtactagattccagatgtgaaagataagtgtcactccttcagacaatttctcccaatttctcctaacttgacagtttcatattgcatttgctacattagcaaatctattatatattatgtaatacatctattatatatgtaatatgtaatacatataatcgattacatgtattacatattttataatacatataatcgattacatgtatcatatattttataatacatataatcgattatatgtatcatatattttataatacatataatcgattatatgtatcatatattttataatacatataatcgattatgtgtatcatatattttataatacacataatcgattatgtgtatcatatattttataatacatataatcgattcataatcgattatatgtattatatattttatgaaatgtaatatatattgcatatattatatattgtgtactatatctattacatttaattatatatgtaactatatattatacattacatatattatgtaattatatattatacattacatatattatgtaatatattatatgtaattatattacatataatatatttagatatcatatatatttttatataatatataaattatatatatttatttatatataatatataaatatctattatatgtatatattgcatataatagattatatgtattatataaaatgtaatatattgtactttacatataatataatatatattgtgtactatattatatgtaatatataatatgatatataattacatatattatatattacatacaatatgtaatatatattacataatatattatatattatgtaatatatgtaattatatgtaatatataattacatataataaatatattacataatatataatagatttgctaatgtagcaaatgcaatatataaaaaaggcaagaacaggttctgttgcattttttttaataaattccctgttcacagctccagagtacaccacaaaatttaatataaaacctcttataacaaaactatatgttaaaataaactaccagttatagtagtttgtgttactttaatgtaaatcctagatacaaaccaaatcttttgtatctgccttgtccaatgttcttgacattaacacattaagactgtttttatttcaaaatctcagattcttttggaaattacaaattaacttctttaaattactaatgactattaacaattactatacaaaaaatagcttttctaagatattgctttctgaagaatcaaggcatatctgataaaatattacaaaatatttctaaagacaggacacgcaaatatcaagttatgaattttttaagagatttaattgagttctcagaaagaaagaggaaataaaataagtttagagaagaggtcaaattcaatagtaaatgtcatgccaggtttaaagtaaatgaaaaataccaaaatcttcacaatacctcacatctacattcatctaactacgcttttgcatattgcacattttgaggtccctgctctgtatgaatctctcggacagagattaggatcccccaaggagtaagacacacttctttctgtgggaaagctcacattccagtgagcactgattcaaggaatatttgtagtccacaggtcccaaaaacacacttataagcaaaatctttatttaaatctcatgcttattattttatgtagctttggttccatgtggagaaatgtttatactgctgtaaacaaagatcgtgttaagaggatatgtgtgtgttagcaattttctaattaaatgtgcatgatttacctttgcccctaccattggaaagaccacccagtaagcagccaagccagcaagagggctgtagggggtgtcctttctttcctctctgctacccttgttgagtattttactcttttgtctatctctccccctcagcccagcagccttgaactaaaacctgccttggctcactctctgtatttcacctcctgctcaactcccagtcccatcaccagcagcctacaggagtgtcacctggagcctggaggtccctttaaccaagaattctaggaacagcctagaaacggagggtaaagtgctgctctcacaatagcagaaagagctgtgttcctcaacatcacagcttatcactcagaatgaagttttccaaagaaactgacatccacattttaacttcttaactattactaatacttcaagtacactacaggtcaactcagcttttgtgacttagcgaaaaataataaatattaatatgaaaactgtttatacgtttaggatattgtacatgcacatagaggaacaaagaaaactggagtctacacaagacacttgttcacccaataattttttgagcacctaataacttgaagctatatacatttgctattacataacagttaaatgcctttattgcctttctttttaaggattgcttctgagaattagagcctttcattctactcatcctccaaaataataaacacagggtaggaaaaattcactgcacaaatctttcactcacatggatgacactaaatcatatccctcagaattctcctttccttgaaggtcctaaccctgtaagaattcatatagccaaccaattccattacaaactgcaaagacctcccaaggggctgaaacacctatccaagtcatcaattctcacataacaaaagttaactatgtctatatctgtgtctatctacctatatgtgctagcacttagaattcaaaaacagcttttcaaaaatagtttcctccagcaagagatttattacagcctattttacttggccatgtgaattttgtttttgtttttgttgtggttgcttttttgttctttaataagaaaataagtctcttgatagctactattgctccaggaaaaccaaatctcttctgaatgattccagatatccaatatgctgccatttttatactccaaaagagaatttggatagctatgtataacccatgaattcaaattttgttttctattgtgcttctaattgcttattcagttaggatgtgggatgatgcacattaatgctgtcaggagcattttaagaaaatgctgagtgaaagacataaaaatcctaatttcattaaaaattagccaaaagacacattagggttatgctaccaactagtgaaggtctgaaactgagaagaaaaaaaaaaaggaaacactttaaggaataatgttaccagtacctttttcttttacttggttcaaaatccctgcataattaatacagtaatacttcataaatgcctacgaacgtaccacctcttctctcttgtagtttaattaggtgattgacttcaggcatactataaattataatgacattttaattacttttttaatgtgcacacttaaaagatttataaacaggaatagaacagcccagtacattgaaaagaggcacaccaaatgaaatgaagcacacgacctaggatgatggcaggcagacgatttctagaagatagaggtgaaccagaaagcgtttcgcatgcttcagtaaacatcagctctactgccttgggacgagttatgaacaacctatacaagctttttaataatcttaacttacaaggaaggagctggatccctctgtcagttacacttctaggccatcccaagacagcctcttcttacagtgaaaaagcacagacttttgaggatcagaccttggttcgaatccttcctttaccactggccagctggatgaccttgacaaaattaacctctctaggctttgagttcctcatttgtaaaatttgtaaatggaagaaaatacctgttttggagggctgtggtggaaattaaattaggtaagcagcatgctgcaactggtgaagaggcaagctctaaatcagactttctgaattctaatcctggctctgcctctaatgccctctagaaccttgggcaagttatttagtttcctgcctcctttccctcaactgtaaaatgaggataatatcagcaacagccttgaaaacttgttgagaacctaaataagttaatacacagaaagcattcctacctggcacacagtaagtgctcaatagatgttagctactaataaatcactgagcataatcattgatgctcaataatacttggccatacttaatttttcttccttttctacaacccttatttcccattagtagacagttcctgaaattccacatctgctgtgaaattttcttgtagcgttaggtcagtgctaactcctaactcctttattacctctttctcccatgtatgtagatccatgtcaaagtgcctacctttaattttaagtttctataccatgagcatttagtctgggagattctctttataaggcagaatagtaattccaaaagaaataggtactttgatgctaaggacaacgaggagaattactgggaaaaggataaatatataaagctgtggaaagggctttctctttatctttgaggtcggtctctcccttagttgatctgaccacatcaggatttcattttactctaatggggtgaaagtgcaatgagcctcaggccaatgtggctacttacccctttctaactgctaaaatacaatttccctttgccattaactatctttataaaaagcgaaaaagaaaataaaaattaagctataatcttccagtgggaattttcagtcctccctgtggtaaactggtgaacaggagaagttgacaaagggtaaggatccagagggttataagaaatcttaggtagagaggtactgactccagtatttccaacctgctctgggtaagtatggtggtagaattcttgtaataaataattggacgtgtgtgttagtgtgaatatttcttttaatccaaatacacttattaggaagcatcactgtctatatcagaaaacaaggattttactcttttgctattaggtatttcatagtctttttttttctttgcatgctattaagtatcaagttttgtgttaataactttacaggaaggctgtggccaaacctggtgaagactacacatcagtggtctttcttattatacaagccaggcaatcatatatatactcaaccagattgtattaactatcagtggtatttatcatcatggcatctaatctactatacatttggtcaaagataaaaaagtatctggcttgaagtgccttctacaagccagttgttatcgttacagattgattgcaacagatatgcttttggtacacagaatctgaacacattatctctgactcttcctccacccacttcagtgacagctttggtcagcaacagctgcagctgatatattactctacttgtttaagaaagtgacataaatacagagacgagatgacataaagctgtgaatgttggacatggctcttataaagttttcctgagccaatcaaaaaaacaggatatgtgctaaaagaatttgtgtatgctgccagttacttagaaaacatgtggacaaatatatgctttcagtaactaacgcattaataaaggtggattcgcatgcaagacttggttgctatcctagtggttttaaggcaataacaattccaataggatcccatatgaatttcttgaaacgttgtgctagaataggtcatttatttttgcacaggttcctattcttgcaaataaaaataaatttccaacagtctcacggtcatccattgaataacatgacttcaagtcctatatactgtcattttatacctctaatctggcatagattagaaacagaaaggaaaattatgcatataatcttaaaactagaaagatcacattgcaagtcagctgtgtcagtaatttccgctttcaggagttacacaatgcttaaacaatagttatcctaccgggctacagttcacttaacctcacagtccagctgatgattgatgaagggtcaagagggtagcagactttgggtgcacaacacttcaatcctttatcaaaaatggcaagaggccacatactacaataacggaacaaatacttccttttaccgtacagtaaattccttcctctgattggctaaagcttcagtgcatggttcacaagaacaaaaatacattctatcatgagcaaaacacattttaaagagcaatcacttaaatctcgggccaagtgaaatgtctatatccctataataattaataaccaagtatgtctatttgtctccttatgctaaaatgtccatgaaagagttgataagtggacttctgaaatctaactcttcagctcatgttgcacaaatccttattcatcaagacacacacccaactataaaggcaattaaacttttcagtatgtgcatgaggaatacccagaatgatctaattcaatatagggcaaactacaatactacttccatctttgaaagtttttaaaaagccctatccagatcattattataaattaattcagaatcaggggatatatctattttgaaagaaaataaggggataaaacattatttcaaatgtgtgaaattctggttaattggattatattatggtaaataagggttaatcagaaaacacttatcctaacccatgttgttgaaaaatcttatttttcataattgataagtattgcctctgtaagtatagcattttctcctttttagtgtaagtctgaacatcgattcaaatttgtagaataatgtagatttaggttaggtagaagatttaaatataatgttgaaaatcctagatcagtggttctcggccaagggtgattttgccccctaggggatatttggcaatgtctggagacattttttattgtcacaactggggagaaggaaaactactggtatctattgggtagctggccaggaatgctgctaaacattctacattgcacatgacagcccctccacaacaaagaattatctggaaccaaatgtcaacaatgccaaggttgagaaatcctggcctagatgttgctttaaaaaataaattactgatagtatgtcatgctttcttctagctacctacctcttccctgaaaaatgaagtgcatgtagccaaaaaaaagtatattatagctaatcaaaattttattccataaaaacaaattcatttgataaatatatatagtatcaactatgtacaaatttctgactcagaataaaaaaattatttcataaaaataatgtgttcaaatgtaatacccaaatcaatgcagtctttacacattaatgtgtgtgaaataactaattttaaaatttgttttcagtattttaaaaattctgaagtactatactgaattttctctgatcactttcccacgtcttaactcacttgatttttagcatgacaaatagggcactccaacttttaaagctatttataatctcagaacccaaagaaataaatgtaaaagtgtatcgccacttttaaaatttaaaatgtattaaaaatgtatactgaatcacagattaaccagttaaatcaaactaagagttacgttatatatacattaattattttactctactctccaacttcattttattaacacagtgacccaaaaaggcttgggttgaaagggtattaatactattaatcttgtaaaacacacacatgttcaaccattagataggtgttcattaccttccttcttagcaaaaagagaagactgacccttaatttctcccacagaacactgatccaaagtggcccttcacagagattgaaatgcaagcctcactcagaggccacaaagagacaggggactcttaaaaccatctggcagccgtgaccactgaagggctgcgcattcatgttctacatatcacagacagaaggtcctggatccccaccaagacccacctgggtctgcagcagcccacaccctgccaatcctttggggttcagcaccaaaggttattattgacttgaacatttttatacagcagagaaggacccatgggttggaatgaagaaatatgtccagaatccaggaggtctgcttcctcaccgcactctcactgaccacatgcctgtgagccagtccttgagtgtctctgaggctcagtatacatatctgtaaaacaggtgttgttgggaggattaaatgaaatcaatgtacatgaaagaactttataaactgccaggccccataaagcgcatgaatttgttttttgcggaatgtacaatagggcctctccttcttctttctctgacgtcccatgagcatcctcctgcccccttttatttactctcaagagacaggtcatcaaactgaaccaaatcccatcagatagaatccacaacagtctgagagatgcgaatgatacattccatcactttaacatggaactctatttcttcctgtaatctgtattgagtggcaagtgctctgggtgcattacttcagttaggcttcacaacaaccctaccatataataatcatccctgttctaccagcagaaaagtgaagcacaaaaagatttaaaactcacctgattttcacaaagctagaattgagggaaccaggacaggaggcaagcccatttaattccagagcccacactcttaacccctaccacaaacaacctcccattttaaaaatagagttgtttctaaaaccaaataccaatttttgtaaagtgagcctcacagtgtgctgagagccaagcaatgtacaattaccataccatatagatatactgaatcttttcactttgtacacctactcttcccaactttctcttggtcaggacactgaaagcgggaccagtgaaaccgacattttgcctaaaacatggttctaccagtgattttcttaagttcaagaagaaagtcgcttctccactgagatatttacaatcatctctgacattgcagaagtgaattactggtatgtttgatgagatgatgcaatcaatgaatatgtgaaaataatggtgataataatacatgcttattcataacacttccaggttacagaatgcttccattatacattatctcacaagactggatcatccagccatgaggggaagaaaagatgtgcaaatattggaaggaaaaaggtaagccaagcgtcagagtaaccaaggagagaactagtgcccagggttcttgcttattcattctacaatgaaaactgaaattttggaacttctgaaggactagaaaagaacacatatcttgtgattccaaaataattttgaaatattttccttttatgcaagaccataaaacaaaacaaaacaaaaactttattaaaataattctatctgcatttttatattataaatataatcctagaaatacaaaatttaccttatggagtacattgtgtgaatagatcagaagtaaaaaaaaaaaatcacaaaaatacataagtagaaaagtacaatgtttgcattaataccctatttggcccccatccatttttatctctcctctccctaattactactagccactgcaggcagttataatgacttagtttgcctatcccctccaggcttaatacaggactttataagggactcaactaaggcatgaaatggttaattgatggaaattaggtactataaaataaatggcacacagacaagccaccctaaattcagctgaaatgcaactttgagcaaaagcaaaccacaaatttaatagcactacaacaaaaaatgttccttttgaacttgacagttcccagtcattcagcccagagtaacacacagggaacagtcctcagaaagttctgtggtgtcttctgaatcactgccattacccgagaaaaccccaggaagtggtttgactgagtagctggaccagtgcgtaggtatcagctgatgtctctcacacatacaagtcagtaacaatggggacactgtgaaaccaggaataaccttccttatctttagtagttggggaaatcatttctaactcagtgagtatataacttgggaacaggtcaaatggttaattattcactgagagcttagtaattaatctgcgttagatcaaatatcatcagacctgaataacataaggatgtccgatgtctggaacaatgagtctttggaatcgcttccataaagcagcaatctttcctaaacagttatgtccaacaaagaacaaagcctaaatgcaggcagctgttggcaaaaactaatcaaaatggaccgtgatttcataaaacctttcaaagtcagtttattttaaaatataagttgatgccatctttttctgctccagcaaatggttggagcaaaccatactattaggtgaaactccagctgctgataaatctgggcggtggcaagccagtgagctcacccggaagaaaaccatgcagtcacagagtccatcctcacatgtctttatctaacaaccaaaggaaaccaaaggaaaaggtccaagacatcctgccaaaccaaaactaagagagatactgtgatttatctaaacccagagatatgaactaactagctacctcttttctgtaacagaagttagccctttaatggccacgattgagggtcataaaaggaagttatgatttcatgcagtattgggttttttacaattcataaatttcccactggatgcttttcagtgtattatcccaatggttagcacctttttgactgatttgactattgtttttctacattcccagcatctacaatcccaacttctggaagttttaattatccaaaggatctaacaaggtcacaagggcaaccataagacacaacttttacccataacagcaatattcccctcacaagaagaatctgcaattccaattctaaagcattacacagcaacccttttttacagacaccacacagctttgaccccagcaagagcccactgcacagaaacatagaacagactcacctgccttcaacactcagcagtatatgtaccaagagctctccagctctcctgtgcgaagccacagccaccttttgggaaatcctttatatctactcactagaaaaaaaatggctgtgtgcccccaatccaaacaagacatttaaagaagcagacttttttcttatctctactttcccaaaagaagtggataccttaaaaacaagctgtatattcaaaacagcaaattctgggatggactgagaattaatccaatcaccaccattattttgaacaccaatactattgactagtaaatgaggtacaccatgatttaccacaggcttacatatacgaagtgtcttttatgttattaaaacttaaaaaatcattgtaagtataattgactacattatttgaaaacaattaatccatgaatggaatatatgattattctcaattttgagcacacattttccagccactctggattgagagaaatgcaccatttgcgtatactgaatctggcatgatcatatagcgctaggttcatatattgcatgaaaaaacaagccttctccccattacctcttcctatcctggcccatgggaattttaagaacagcctccaacagaataataaattaacatattcataaaaagaatagatgaggtgttccctagctcctgaatttttttaagttgaccaataatttttcaaattatctaaggaatgagcaacatccttctaaaatactgagttttctgggatctgaccaacatcaaaagaaacacacagttgcaccaatccctgagcagttagcatgacttcggtctgaaatgggaggacacaccatacttaaattgacccactgcaaatggttcccctccactcagccatttgctattaaaagaaccaagctgttctgaagataagcaggaagaggatattcaaaacgtgtaggcgggatattttcacagagcttctctaaattccaaatacctgaacaaactgaaccaaattaaaaactcaagtttttaacctgagttaataaaaaacaatgttcacttcctttttcaactactcatgaatatataaaaacttaaatgaaataaaaatctataacaaaacttttggtaaggttgcttacaaatgttttcaaaacaccatgataccagaagtttaaatttccatttttagatttttttttctccagctcaggcttaacaaagatatacctgtttagttgcttttttaaaaaatctatttttatcccatataaattagtaagcagaccaagcatgattattgttttgaaatcagtgttttcggtagacagcacacccttattgaattataaggcatgtactgagtatatcctatatgctatcaccaaggaggttcaaaagagttatgactataaaccatagccctatgcctaaggactaacaactaggacaggaaagacatgtatatataaaacaattatactcttctatgaggggtagagtcaaaagagaagaaggaaaattattgacaaatgcagccagcaaggaccaaaaagaaggacactcaggagggaagagaatgagcaaaggcctgaagatctgaataaacatggtccatttataggaccttaaggaggtcaactggactggatcagagggcttagagacacgataagaattaaaactggctaggtagggcagggtcagaggtcccctgtcctgacacctttggtttacagataaggaagctaggctcaaagtggtgaatgagtcaacaaattctttaagtgcttcctatacaccatcttctctactaggcactgagatgcagaggtgaataataaaatgtcagtgacctcagggagtccacactggggacagacagacaaaaaatacatcaactattaagttgatcatttcagattctgatcatttctatgaagtaaaaaatgcaataaaaactgaactagggatggattaaggaaactgctcaaacttgggtcacaggtggcctgtccaaagaagggacatttgagttgagacttgaacaatgacaaggagccatgcaggggatatgcaggtaaaaagcactgccagcaggaaaagcagtaagtgcaaagacagggacaaaaacaagctcagcaagtttaaggaacagaatgaaggccattatgactggaacctatctgggaatggggtgtgtagaggaaaatgagcccagagaagcagagccctatgggacatggtgaatagcttggattttattctaaaggttaggagaatgcatctattagataatttttagcaagggagggtattatataatttatatttaataggctactctggggagtgtggaggcagggaagcctagtaagagcttttgcagcctacaaggacagatgctggtggcttggactgaaactatagcagagcagagagtaagaagacataacattcagcacttattttggagagagagccagaagtacttactggattaaatgtgagtctgggaggaaggagaggaatccaggatgaattctggaattatggcctgagcaacaaacatggttgatttagtgaaacatggttctgtttggtgaaatggaaaggtttggtggaggagcacagctgtaggcagggggacactgatagttctcttttgcctatttcaactttgatatgtccattggacagccaagtgcatggatttaggaggaatacaagttgaaaattcatgatagatccattaatgaaaataaaactttgaaaattatttagcatattgatgatattctaaaccatgctgggatatctgctagaaagagaatttagataaagaagataggaggatttagatagaaccctaagggagtccaacacttaggggcagcctagcaaataagactgacagggaaagatgggagaaagtgtagtgtcatggaagctgggaggatcaagcatttcattaaacaagacagagtggtcaactgttcaaaacgttgtaaagagttgagaagatgacgacgaagaatgatcactggctttggtaagatatatgagaggtgaggaacttaagacagttagtaaagataaatttgaggagttttggtgaacagtaatgtttccagggtcacaaagcaagttaaagccaagcaatttaaaacaggtctctggattccacttcctgtgctatttttgtggctctaagctacctgtcatcctatggataataaagaccctctgaagaactttgagcaggaaagaggggtgctaaaagagagttattgtaaaattaatctgatagcagcgtatgagatcaattcaagacagaagcttccatagtagacaggtgcagtgatgagagcctgcattagtagacagcaaaaatggagaggaataggccatagggacagctccaaagaatgcacaaggccagggaaagttagaatgattcccattgagtgccactaatcccaagaatcattcaacaagataggagaaaataaagtgatgaaatgcaaaagggctaagtacttttgaaaaattctattataggatatgtcacacaatgcctgtatttaaaaataagacataggtcaggagtggtggctcacatctgtaatcccagcactttgggaggccgagggaggtgggttgcttgagcccaagagtttaaggccagcctgggcaacgtggccaaatcccatcttcacacacacacacacacacacacacaaacacaaaatgcaaacattagttgagcgtggtggcatgggcctatagtcgcagctactcaggaggctgaagtgagaggatcacttgagcccagggggttgagattgcagtaagctgagatcgcaccactgcactccagggggtgcaacagagtgacaccctgtctcaaataaaaacattaaagtaaataaaggtaaaaataaggcataacagtttctacaaaagtatcaactttgtatatttttgcccttttctttattatcatatattatcacttttaccattgttaatgctttgaacaacatataaactagtcttattggccatcttcaccatgtagtccaacctgtgcactaacaagctcatgaagtacacatatatctagttagttttaatcaagaatgccctctttaattattcaagttttattaggtgactgctaagtaactaaggccaagtgaagaaaatatggccacaatataagaaaatatggccacaatataaatcagtatttccaatgaataccacaatacaaatttttatttaattccccagaaagtaaataatgtaatatcacagttcagaactgaaattccttttccagaacatttccattcaacactatttaggatttacacatcttgttcccgccctaaaatggtttactaccaaagtccaaattgtatctcattccaatgtattgtgcatcattctacacctttggttaaattagagaaagtaaagagaaaaaaaaaatccaaagtttggcagttgagcccttcatactcctaaactatatctttactgaccttttaattccaacatgtgaaaggcactagaaaaattaggagacttcctgagatcacagcctcctgagaaactatgctattgtccccaaaagaaatacactggtacaagggagtgaggtaccatgaggtacaatgaggattataacatgggcttgtaaaaggtatttcaactattctttagcttttgtgattagaaagatgtattgcttgatcgtggaaatgcaagtgaaagaatgcaaaggcaaaatttccaaacaagtgctgggattgtgtgtttctgtgtgtgtgtatgtgtgtgtgtgtcttaacatggagcccaaaaggtgatgcagcactcttccaatatattatttaactaatcctcatgaacatatttccatcactgatttttataggagtggaggcaatcttgatattctcggcaattgtcaggcatatttctgatatcatttaaacttctgatgcagtaaattgtctccaaaaaactctgtcaaaatccacatgacattggcttcagcacaatgagaaaatgatggaaacagagtgtactctaaaatcacgttaacacagactcattaatcactgcatagctaacaaatgttcccaatttcaacatgtatttcaaagcacagctctacacccttctgtatacataattttccaaacgattcacagctaaatggcaacgaatttatacatccattaagataacaactgagaatacattttgaaacaagtattcagacctagagtttctgtgggtgtgaattcatgaattcaaagcctatttctcgccttactggtgacagcaactgaagcaggaagggatggtgccggcagtggtcaaaagctgtccataaccccatgtgaagtcagtggcaaccgtctccaagttccatatgagacaagcaggcactgaggatgacatcagggaagtacagagtgttttctgtgcctccccagatgtcctggcaggagacaggcttttcccaatctaagggaaaaccagccaggaaatgtgtctcagttgacagccccagatcacaacttctgagtggtgataaaaagtgactgtagggacactgagaggcctctctgcaatcctgctgggactgaaggcacctcgcctcatcatcctaattacagaaatcctaaggttagaatggagatggggctccaaggtgaggacatggtatggggcaaaggaccttggacttgaactcagaagacttgatatctatctctggctctgccactcatgaactgtgtggccctggatatgtcatctaacatgtctgatcctctattatgttatttataaacttagaaaaagagaaatatatatcctcactatcatacggcttttgtaagaattcaatgagattatgtgtgtaagagtcattggtaaattacgaaagccggcaaaaatggcgatttctcactttatggaggggcacatcctttatactgtaggcaatgggtactcagtgaagcttttagatcttcacagtaacctattaaacgtgatgttttaagaagatgagccttgtagtggaataaggaactgaccacaaacagagtaatttgagtcaggagcaccagctaagaggctgtagtagaccaggcatgatgaagtagaatctttctatggtagtggcacttacactatccagcagggagcttttgaggaagaacatggatgttgaatgttgagcacagcgtcaataataaattagagatgattattctctgagctcccgttataataaactccatcctccaacctcttgagccctccactagcactgcaaattcaaccccattatcctcttgacctgctccttctcctctatctcaaactcagatccccacttgctaatgcaagacccccttctctccttggttttcacttcttcacagctgctggagtggctctttgctctcatgttgactttgggtccctgattctcaaccatcccaggccatctgacttcagctgtctgagcagctgcagatcacacagtcagatacttcattaacaccctccccaggcttccacagtctcttctccaggcagccttccagcctccttctgaccctcccatgcccgtctccaaacatggctcacccacaggctgcgttctgtttccctggtttaaactgcaatcccagcaaaagtcactcaatagtgccacatgggccatgatctctgacttccaatgaattctttgaggaccaagactatgtcttgttcatattgtatctacagggactagcatagaacctggcatatagaataccctcaattgaacaccaatttcagtgaatgaaattgataatttggaaactctataattcatctctcctataatggtgcttttcttggcgtccacctaccccctcactactcctcttagtcatctttattagattctattattcattcgtccccaaagcaggaatatttcccaggattctaaactcagctctcatattctctctttgctctctctccagcagagaacagttcccaccagcaaacacagtagaatgtcaagacatttcagatattcaccctcactaggacccaaattcaatgctcctgccaacaaccccataacttgcaccctcccccagatggtgaagccacaccaaaaaaattgactccaatgagaaggaacaaaggtcagagaggaattggaccctcccagtggagacagctgagcctcaagtgggactgacaggcaagcctttgccaccagacacagtcaccagcgtgtcctacattgatgacaaagaagcctctcttctcagggatcattacttgcctttaaaagtccagattctctgaggcctgggagctttatacctttaaaggcattcggtgtcctctctttgagacagtcttccatatccaagagaaaggtttgcttcagcacttcattacaaacggggaaagctgccctacacctctgagatcctagtccaaacctgtccatttggcctgcgtggctcagactctctttgatcaagtccccaggcaaagttcggcctacaactgggctcttcctagattccctccatccatcaatgccttggcacaatttgaggccacaatcacaactgcaggttcctcacaccctcatctcgacagaacagttatataaaataaaatgtgtcttctccccagcagttctggtctcagttactggcatttccattccttgaaccactggggttcagacgtaaggcatctttaacatctctagtactcagtttggatcaagcatgaaatgtcattttttttccccatactagactcaagtttcttgaggaaataagtttttatcttatgctttatggttaaaatgcatagatcctctttcatggttttactgtatgtttctgaaccttcttaagcttgttccctcaggagggaaataaattctttattggactatgccatgtggccttatgaatacctctccactcatataaaactaacctaaataacagaaggaaacaattttggatatggccttatccagttcacacgagtcaggctgtgattttatggaaaattaggcacttgtgggcaattagttgtttaaatatctataaatcatcatgtcaataatttttaaatgtccagttaaaaatttaaaagtttggaaagagaattttttaagactaattctgtagcaagtgaattaattccaagaaaatgaatgtagacaactagagcaaccagatttgagacacagtaagaatggccctacacatgttattagagtacattcctgtgcatcctttagttctgaggcaatcagatagtgtcatctaactttagtgaagttagaagaatgcctttaataaaaagtcttggacctgagttctgtcatctgtattcgaaaatatggtctctgaggtcctgctttcagctatcaggatagttagacctcacagatctccttctctcttagaaaatgtatattcttccaagtaaaaagagtagaataaaatatttccactaaaatgcacttatctctacatactatgcctcctcagagatctgtgtctctcgctgagttcccagtctcatgctctatgaaagtccttcctaaaagccaccattcaacatgagcttctagtcctgctgactcaaatgatgacatcttgttatagaaatctgagtgcctcacagtggatctacacatcagttactgatggccactgccaacctctgtcacaggaagattaagataacacagttaaagctgtaaacactgccctaattatcagagtttgctaccattatcagggctgcaggaggactctacccagagtcatcacgctctctcctgacatcatatatacgaggtcagagcctttcagctcctaagccccagcagacaagctccagtgagcagagcttatccttaagccactgtcaatacaatgtgtaattttgagtataaagcccatccatttattaggccttatattcttcatctataaggtgactacagtgaagtatgaaacattttaaaacttggataatcactaagaagaattcctaaagctaaagagtccttcaataccgataactcactgattacatagaaaagaagtagaagaggcagagggcagtagctcatgcctgtaatcccagcatgctgggaggccaaggtgagaggatcacttgaggccaggagtttgagatcagcctggccaacacagtgagatcctgtttccacaaaaaataaataaataaatagccgggagtggtagtgagcacctgtagtcctagctacttaggaggctgaggcaggaggatcatttgagctcaggaagtcaaggctacaatgagttatgatcatgccactgcactccagcctgggtgacaaagcaagactctgtctataaaaaacagaaagggggggaggggaggggagggaaaagaaagaaagaatcatatattccctctcagaatgagctttagcaatgggtcattccattgttctgacagtgtcaattaggaatcttcctaattttgagggtttctctttatcgtttacataacgctggcgtaatgtacctttaagaaggtaaaattcagtgtcacattacctcaatgttttaggttggtttttggtgttagcttcactctcctaaaccctgcaacacaataggaagcttagtgaaaggaccacatattaaccaggaaactccatcacctgcactgaccaaagctgataaactaaccacccatactacattcaaatagtctgatcatctataagtaataaaagtgtctccatagaaaccaagtatacagggaaatctgcttacagtacaggatctgcttgaacaaaaagacttcacttcaagccaagattttgctctaacttaggttcacacatcatcatacacggatagcattcgatatcacacctttggaatttcacagtcctgaagattacaaaaagctctgcacatggagagagaaaggggggaaaagctttgggagaaaagatttgcatatgtagttacaaaaataccaaagcagattccatgctaagctctgccaaaaagagaacaattactgttgcccatcagcacgcagccttgaaattatattctcttctccaagcagaagcagtcatcagattatcaaaatgaggttatcctgactcaattcaaatagttcttatatggaataagcacagtgcaatcaacagacaagcagctatttccttcccacacaaactataatcttttgtgaaatatatttttaatgaagaatacataaccctcctacatgtttacttctgccctcacactcctacacataaaagtgcaaatacattttaaagaaagggagaagaattttatagcttctaataacatcccttacaacgtagggcaaagaacagtagcatctgaactaaccctcaaatgaaactttttcatatagtgtgatgcttatgaaagtaaagctagtctccagcagctcctcaggaaaagtacaatgaaatcgacataaacaatggatctcaccaatattttaataatttctttctaattagatgcattgtgaaggcttaattcattcaactactaataactcaaaactcacagagctctgagctttatcttttgcaaatttcaaattataaatttcttgtcatgagtcattctgctactcaagaagcaagttttcaaaaggaaggtttttcttttttgtaggtaacatttatagtgacagtcatttttctttctcctttaatcccttgaattttaaatgtctaaaattgaaataatatgacttgatgggtgaaacatttttaccattaggttagctgatttgaaatgaggctataaaaataattatgaatgttcatgcccacttaacagaattgtaaaacagataaaagttttaaaatctctttttccactagggcttttttatcctacacacaatatctgtttgagggtactggatcttggaatgcatctcataatttggttcctaggagggaaaccattaagaaattaattacagtgacaagcagccttggtgatctcttacattaagggaatatgcctttgttctggaaaaaaaaaaggaataaaacttggtaagccaaatcaataagtgtctttaaaaaaatagccttagaagatcagaaaatcaattttgcctaaatgtgtgaatgatgtaatcctattacactaaaaggagtgttttaattttgcctaattgtcatttaaaaaaaaaagaacaaaataatcgctgaaaaggtagactaaacaaacatcgacaaaccagtgtcgtttcattcacacctagaatgatgtcgtttcattcacatcagaagagaaccttgtctccttaactcagcaaaagctcaagaattacttttgcaaacaaagtagcatagggtaaggatagagacaggaagagaaagaagaggaagagaaagaaaaggaggagttaggaagacagactagcaaaaaagtttgggagatggacaccgttatccaaaagcaaatgtagctgctgatgctagtgactaaatctcactacatccagttcaggaaccttattcacacgtgtgtaagaaagaggtggggaaaaagcaagacaatgagaaaacatttttgtgcattcagttataatgcattttcacacacatacacaaatgcactgctctgctcctcaaagcatgctgataagaggtgcacgttaactttcaaaatcacctccagatagatacccaagcatatagagattaaaaacgacactaaattcctacatagcactaggaatgctggcacacctttaaattcaaaatctctgtttttatacaggattgtaatagtccagttgctcatggaccaatctaactgatttggaaaacaaaatcttaactaattgaagaaaactcagtgccttctccagtcaaccccatggagttactctgcgcagcccatggcaaggttctgactgccagcttctttaggtccaggaaatgcacctttccccacacacagccatggaggagggctaagaaacaaactgagccagaattgctgctgttcacaaaaggaattccccctcccttcccctccttctccctcccctttcttctctcgtccctcccccatcatcgctggagaataatatcactctgctacctgccttgagcaacaccgtgagcccctgtcttcaagcattcagggaatttaacagcctggaaattcctgttgtccattcgctgaggtcacagataaagctaaacaacaagccgtggttcccatcaatcataagtcactcactgatagaatgtatggtaggagacctgatggaagcgagtcaccagagaaaatacccactgatgacgcatatccaggcataaaaatagttacagggccctcaaagggattattcaacagcctacatttagactttcttacaagagacctgaagtcaacgtgctgcagttaagtggctggagagttgaagtttaagcttcctcaacagacataaccacagaaagctgttttaaataagctcccacaataacaagctgtttagtaaattttaacacaactttataagccgtaaacagtaccaccaactatcttataaaatgccgcctaatcttctattttattcactttctccttcaaataatgatttctcttctttaactcgtagtccccaagcagtaatatttaatcagtccaaagaaatacagccttacttgctttccaaataaactttaggaaaacaacacaaattgctttctgcatctatatctttataaaacatgcttttaagtaaagcttaattacaaatttcaccaaaaatcctgacattttgcccactgtatttgcagttatctttttcatgaattggtttgatcctttacagaaataattaccacatgtattacatatacctactaaatatggtatcttatacaaagtaggcattattattgtttgacaaatgagtgagtgaatggatgaatcaatgaaatgttatgtgcaagtattttaattgagcaaatgacaagtaagatgttaactaagacaaattctggtttttttaaattttatgaggagggaaataactttttatatgtataaccattttaatagttttcaaatcatctgttctcttttcctcccactcaaacatatgcatagctaccctgcaagcaggtcgttcacagaactttcatatcagaaaatgctggattttcgcacatttttatatttaaatatctaaaaatgttccctttccagtttgccttaagcaaatgtgctgacacaatgaacaatgaaggcaactggctatgacagaacccaaaattctgcctcagaacttgaacacttccgacttgcaacaccctatttgttagtcttattacaaatcctttcctaattgtggacaggtttccattgttacccagttaattattagccatagaaatttatctatgatagaatttatctcagtgcttaatgttattaactatcttgcccacacaaatggcaaaaaacctgttaacaacactgttctaacttttgacaaaacatgtttagggctttactctggagggcagctctccagtgaacaagtagttaacaaaatgacatttctcttcctgtcctggtaggttctacatcactttcctcaagaatgataacactgctacaaatacaggtgcaacatatttttagtactaagatttcacaaagcattcacgtttctctcctgtgcatatgtgtcaacagtatgtggcctagtttaaagaacctaaatggaaatgttcactggtgccctctagttgatcattgctaaagcaattttgaggaagtacacgtgtacctccatcatcccactcataaatattgtaaagttcccaatcaacattcagccattaattcctgacataaaatgtgaaataaaaaatgaaatttagaaactgctttatttcataaggtttcattatgcatttttttggaaaatgaacaataaagaaaaactttgagaaacagaaaaaaaaacctaaaagataagatgagacatattcctatttgccaaagaagaaagaatgtattaatacttaatattaactcagaaaccaaaaatgtttcactaattttacaaaaggatagttcaaaatcagccaaggcaccctgaaatgatcatgtttcaccctgctacatacatttgacagctttcagtcatggtggtctatgctggtcaagtctgaactgaggatcctcagataattttaaaacaataccaatatccaaaggagacactattccaaattgcactgacatattaactatcaattcagagatcaccgattgaatcccataaaaggttatttccatcagcactcttagttttagtaattccaggcctgttaaatttactatcaacagaacaattgttttttgttaagagaaaatgaaacttccttaccctagattagaaactatgctatcattacagttatttaaatctgtgagatcatttcctgcattgtctcctccaatgaagaagttaaacaaatcaccgtttaaaatttaaaaatgcaaaaatacatttcagagagtatgtgcgtttatctttctgaaatatcaaacaatgtaatcacctggtcactaaatttaggaccagattatttaattatctggaaagaactggggggaaggggaggatatagcaaagggcgatgcagcaaaaaaaaaaaaaaattgctttttcaaattaatctttctagaaacaatatttaaattcattcccctatgtcactagtaaaataccatgacaataaatcattttacatgttttaactatattcaaaaaatgggaaaatacatccctagttcactatcctacgcccagtcaaggacagataactcacatttagactataaagttagttttctcctttagtctcagtattatgatgggattctgttttgttttgttttgttgtattgttctttttgagacgctcactgtgttgcccaggctgcagtgcaatggtgtgaccacaactcactgggaccacaggtgcatgccatgtaaagatggggtctcaccacattgccagggctgatttcaaactcctggactcaagcaatcctcccaccttggcctctgaaaatgctgggtttatcaatatcagccacagtgtccagccacagattctgctttatttttaattaaaaaaaattacatccttacatctcctcattgtttaatagtgacattttttcatttagtaaataagattgcttccaaaatatttcatgggcttatgctcattgaagtcattatcttcattgttttcccaccctgcaatgcacctgcaagagtgcatgcacacacatacatattcaacctttccctcatgcctgatctcctttgatgaggtcaaacattcaaagaacccaaggtatattcaagagagtcatccttaactcctccttaaacctcagctcccatgtctaatcaccaagccatgacaattttaccaagttacctctcttccttgtctgtcttctctctaattccactgtcgtgaccttagttttaccctttaacccagtgcttctttcagggaaataaaataactatcctcagttctccctcttctcccaaactatgctctacatgaccaaaaatgagttgtagaaaacataactctgactatactgctcattccatcaaaacccttcaatggctcctagttgtatcatacaaagtcttgtatcagagattacactatcataatttttcatttatgtgttcgaactttctatttgattttgagctccttaaggtcagagactatgttatacttattactgcatctccagctctcagcagagtacctggcacttttgttgaactaaagtggactgaatgacaggacactgcattgacattttaaactcctgatgtggccatgcatggtggctcacatctgtaattccagcattttgagagactggcaggaggatctcttgagtccaggagatggagaccagcctgggcaacaaagcaagaccctgtctctacaaaatattagctgggtgtggtggcatgcacctgtagccctagctacttgggaagcagaggcggtaagatcacttaaggaatttgagattatagtgagctgtgatgatgccactgcaccccagccggagcaacagagcaagtccctgtctcaaaataaacaaacaaagaaacaaataaacaaaactcctgatgtggtctaactagactagataaaaagaaggtatggcagagcaattctctctgaaatcaaagaaaactgaattcaacaatagtcttatcaaatcttaggcaattacataacctctctgaaccttaggttcccaagatacaaaatggtgttatggcaaatggaataacatacactgtgtgcctcctacaatagctggcacctattgagaaggtgctcaataaatggcagctattattatgtttagtgatttctgctgtgcaattatacatacatttatcagacatcaaaatgacctattttggtgctgtccactagacaggtatctatatatctatactgtctaacactgtagccgctggccataaatggctcttgacacttgaaatgtggctagtataactgagaaactgatttttcaattttaattaatttaaatttagataacctcatgagtctgggtggctacagcactggacagcacagaccaaattagccctgacatcaatggagcaccctttaagtgtctatcatttcccctttccccaaaatcagtcttgtttacaaggattcaagtgccagtgttaattagggtctatctatgtcttcatttttgttaattcaacattgcctgctctgttaaagaaatcagacctaaatgcctatatttttcactccctttgcaaattagctctaacactagtagaaggggctctacatcagtaaaacaatccattctatttaagaaatttatccatgaaagtgtgagaagatcagataacagagttccatagagaatcttcctcaaataagctcctccaaaactttgtatctttacaaagttaacgcaattcagcttttattgcgtgtacttcttcacatattcgtgcacttgctctgcattccttctaacactctaaattcattgaaggtagaaacgatcttgcttcatttccctgtacacattttgaaagaattactgccaaagaaatgaatgaagaatacagtccacagaatggaatccccagcacaacacagagagatggatcagagtggcaagtgcacaggatctggaccaaaagagcttgcttcaaatctcagctctgccattaacattctatgaggtttggaaaaatcacctgacctcctatctgtcaaataatgataatactaactgcaactcctaaatatcctattaatataataatctaatgagataaatcagacatataaatattagtgcaaatagtgtaactgagaaagtaatacaaaaaacacttaaatctctatcttgtatattactacagaaaataatgtcccataaatatgaaaaacaccaggtatctgtcttgacaatctgtataaatgtctagagggaaagatcaattttaaaataattataaggatgattacacttccatttgtaaactgtaatattagtcattaccggtggtgtagtttttatctgacatcaaggtcatagaatgctgaaatatgcttttgtatatatggcctgttctccttaattatacctgtgctgtaaagatagggtctgcagttttcaaaagtatttggtaaaaatagttcacttttgttgtttgcttttcagttcacaaagcactttcacttacatgcttaaagttctcttcgggacaactccaagataggttgaggattttagtatttccactttgcagaaaagtaaactaataacaacatcagtaagtaaaaccatcagattaataactcgaagtctagaactcctgttcttgtactcaaggaatttcctactgtttctcatttccaaaggagaacccagattgtgttcatgtattcccacatcaagaattttagcaaaatactaggtattacactgtacatctatctcatcatacatatgtatgtttatatataatttaatattaatattaatatataatttaataattttaaaaagtgttctcacccacactcacttagcagatccttacagatagggtatgccaggtaggacaatcaccatttatagataaggaaactgggttttggaaagatctcaactcttgactgtgtctttgcagggttatggagatgaatgatctgtgcacctgggctatggatcgagatctactatcacccagttgagtaacttcaaataagtcacccaacctccctgggccttgccctcctgtgtaaaatgagagactttgagtcactcacagataccacctagcttttaaaactcttattctgcaattcagctaattcggcaacatcgctgagacacggcccccgatggtctaagtccttgctggttctttgtcctctctcaaacactgtaatccctcttaacaatatctgtttctccacaatcgaaaaactggacttcattaaggagttcattctgtttgtttgtttatctttatagagccttaggccctgtttatgtcccatttattctttgatcttttagctatgtccagccagtaaaaacattccctagaagaaaggctagctgacacatgcaggcacaggggtcccagggaaaggggtgtgccctcacctggcctggcctcactgcgctgcctactgcactttcactttggggataggagatgcttgtctgtgttgatgggttttgatatcttttacatttttattttttaaagaaatagtacaaaacccaagggtgataggaaagacaggctcttgcacccaggtccaggaacagggtcacaacagattttaaacaatttaagtggcccaactaagaacatttccaccataaagaaggggcaagtccaaaagaagtcatgtctaagggcacctggctaaaagtagggactcatgtgcacaaatccacacataccctctgctggcatggataaagctcttcctacatcccggcggaggtgccagagaaataagcaacctgaccccccaagagtctttggagcctggcagtaacctgagctgctctaggttatttttgctgatggctagtggttcttaaagggactgtgttctaagtacacatgtccagacacaggatgcaaattaatgataagacagaagtgattggtctatcttcattaaacaaagtctataaatgcttataatagataaacgagaagacatgtgagcaaatattttaatgacctttcaaagggatcaatcatatatcctgtgatataacatcaatggcttaatacaaggcaatactgaataacacacaattctgttggtgtaaaatgtgaagacagcaggcattcccccaaggctctgtccttagtgcaagcctcctacgtaagggaatggggagtcaagattacagatggaaatgacttccaggactgagctctacagttatcatcccacttaaatgctcgctacaactctcagaagtataatcattccatcgtaccaaaaaggaaagtggagctcggcgaggcttcgtaacatagagcaaaagttacatgacggatgggtgcaagccccttccaataatgtctatgggaaaggtgaagattccgaaagcaaatatcccactcaataaatcattctcatgaaacaattagtcctttcattctctatcccacatccctatattggccaggcaggaactggaaagtgggacctggagtcacaaacacccaggtttgtaaaccttttccaccacaaacttgctgggtgacgttgggcaaggtggatacactccctgagcctcagtgggaataacagtagtatctacatgatcaggttgtttagagagtaaatgaggtcatcatatgtgtaatatatttggaatggtgcctagcacgaagaaaccccacagtaaaacaattgctcttatcagttgcattagtattcctaatgcggcaagtgtgcaattcaatttcccttgaaaaatttgataatctataatcataagaaaaatcacgtaacagctaattatcaagcaggtactgtacagatactatctctggtgatcacaattttgccaggcaagtgatctgactcccctttgcagatgagggaactgaaatttacaaaggtttagtatcttgcccaaattacaactagcaagtgacaggacagcgactttaatttaggtctgacttcaaagcccatactcctttctctcaatcaagaaatagccagagaaatggcatgaagagcagtgggaacaaccctctattctatccagttctattctacaacttgttaactctgccctaaagtcagtgtgtaacctcttaacctgtttcacctgcatttttcggggggagggaagcctaatctctgcagcatgttatccatccattattggtttataggtaattctacagagaatgataaagttctctgtaaacctatttaaaatatattattctaagggttcatttctgagccatggctcttcagaaatccacaagccccatattacataatcatgataaagccacacaaatgcgtaaaagcttatagttcataaagcatcttcacaaacattcgctcacttaatcatcctaacaactgagcaaggtagctatgtgcctgtttctcagatgctgaaactgaggcacaagttaagtctattgcttatagttatataatcaataaatagtagagttgccattttaatagctgggttttatgatgtcatatctgtgttccatccattgtattaagtccagctcaggaaaaatatcagcatctttctagtgtgatctgctacaatctataatatatcaagggacgatatattattagcctctccttctgtctttcaggtactatcttttacttgtgttgtaaaatatagttttaattaatttcaacattatttcctaacatagcataatacctactcaagaaaaccatgtcaacaggttaacttcccaaagtttgactgttcaagagcacaggggccatatcttactcatcattttatagcctggagtaccttatggcacttaaaagtagatgatccataaattaaactgaataaagctcaagacaactgtaactttataaaattatatgtccctattttacataataatttttaaaaactttaaggtacttttaacagtgaacttgacaacagaagttatgtttcaagatcacatttattgagtgtccagcgtgtcttgcagtgctccaagtgctttacatttactactttattcctggaaaacaattctatgggtaggcactaatttttttttattttacagatgaggaaactaaatcaagttaacttggacaagggcatagagctagttagtggtagagcagtcatttgaacgcagggtctccggcatccacagcatgtgttcagaaccactccactacactgtccccactgataatatgccagacactgtcctcagaccttaattcatcttcacaacaacgctgggaccagtagaaaatcatcttggaaattgaaagtcgccttgataattcactggcacgaattggtattcaggagaaaaattaagtaaaccaatttaattgtttataacagtcctgctccatgaccaaaaatatcacaagtagcacatccatcacattacaattttaaaagttgttgggaaaataaaacttagagctacattttaactttaacacttgaactttaaatttatagccagttacctcttcttgaacagtatcttgatatgttttctgtgcagtcttgtacacttcacattgttttctgttttgtcttacagttgtgattctatctagcatccactgaaattttggttttttttaaacaataaaaatctggtagaaatgtttttttcaggacttaaatttttgtctcttttcttgccttcatcttattttctcatctttttttccttcctggtcaaatgatgtaggatggtatgtatagcaatcttccaaaactagatgcttaagagtaggttcctcaaagttgagtctatgggcaatccacatcattatctccagggctggggctccaaatctacattttttcagcaagttgccaaggtgaattctctacatactgggataaatcataagattttcagtctgctgattcctgtaagtggttcttccattgaagcctttttcatttagcagtgtgtatgtgctagttttataaaaacataaacttcactctctagacttcagctgagagtgtcacacaatatggggcattttatgtgctaaatttaaaccaaagattttaacacactgtattatttatttcaatgtgtagcagccaggaaacacaactagagaatagagagtggatcaaaccaggcctccaaagataatgaatggcttaggaaatgcacccaacctgtttcatttgagtttaccgaagcaatagatttttatttttggtgtttcattttcatataaaacctgaccatttgcatccctcaattaaccttcattattaaaaactaccttattgaaccaattaatggccgatgttagagaaaaacattcaaataaaacttcatcagaagttttcatttaatagaaattatttaattactaacaatgcaagagataagctaaaacttagaatgtgaccttttttgagatgtcacttgctgaaatgtttgattattgtccataaaacctgacaggaagttcagattactatatgtgggtctctaagagaggctaatatagtcaattgtgtcacatcacctaccttcctaatcttcacacttagtgtttgttcttcaaccttatggagacacccagttcctcaattccagcagttcaccatcttcctcctcctcctgctctgggtttctttcactattgtctctgaattccactgtgaaccactttgccctttgtcttgccagcatcccaactcatctgataccttgtccttcatacccatcctaaaaaacactcaatttggttcactggtttttcggtccctatgtaatctagaggggctgagaaaaagcaccaatttcacaggctgggctacttctgtggagccctctgaatgtcggcctctcattccaggatgctctgctcagcactctctgccatttccttcagagacaattccaagtgttccccatttttgtcaatattatccagtttttccagataaataaatttgcctttcacttcacaaaaaagaaaaaacaataaaataatgaatttttcaaagaaaattatgtttaatgcacagtttctacccataaacttagtagtatacctccttctgccccaatcagtcctttctggtgctcaaagcactctagctgctccaggattctgctcaattatcatctttcctctatatcatctacatttccctctccaatggctctacttggtcagcacatataaacaggttcacaatgatgcagaaatgctttctgggtcttacctcttattctatcatctcactcctcctacacacagccaagctttcttgaggtacagagtatgactatattgttctcttctctacctccacaaacatagttccagataggccctcaataataattctcattgtttcaatattgatgctgaaaatagagaaagcccaatagaaaggtggaaacatagttcagcagccactttataaaaagagaatatacaacagccaaaaaaaataggaaaaggggctcaactttgttaaccaccagagaaataaaaattaaaactataaggtacaccactacatagccatcagaatggccaaaatgcaaaagatgaaaatactacagcaggttgaggacagttaggaccctcatgcatgttagaaggggcacaaattggcatacctgctttaaaaaggcacgcggtaataactactaaagtggaattcatgcaagccccatgatgtagcgactccacccctagggctgcatctgcagagatgtaccataatattcatagaagcactatttgtaagagccaaagccaaaagtaatccaaattcatcaatggtagaacgaagagattatagcacattcataggatggaattcaatacagtaatgagaatggatgattgttacacatgaacaaatctcactgacataccatggagtgaaataagtcagacacacacacatgacgcagagcatatgattccatatacataaaggacaaaagcaggcaaaagtaatagatatggtgttaacagttacagcagttacccttgggttctaacataactggaaaagggcaagagatgtgctctcagaatgctgataatgttcaaatggtgaaaatccatcaaactgtctacatccttttctgtatatatattatattacacaattttaaaatctggatatactgattcatccttgagccacctcttattcaaaacactcttgacctccttctctgtctcactctatagatgctaagatcctgaggccagggactaatccttgtctatctcggcttccctacttcctatacagagcttagtacacacctgctctcaacaaatgattctggatgagtgaacgagcatggcacctcagccccactgattttggtctcttttatgctcttgatgctgaagtctgcattttcagcctcttccctgggctccaggtcttgatctctgcctatagacactgcagtgataacaacctaccctttatttggaactggctttgagtctggagctttacctatcacaaacagcctgcatgttactaattattaccctcactttacagaccaggaaatcaaggatcccagaggtttacctaagaatgcacaggtgataaactggagaagtaaaattgaaactcaggtctttcttatcccaaagccaaggatctttccacagaccacacatgaccacagatacaataaatctaaaatgtaggtcacacaggccgcgcgcagtggctcacacctgtaatcccaacattttgggaggccgaggcgggcaaatcacctgaggtcaggagttcaagaccagcctggccaacatggcaaaaccccatctctactaaaaataaaaaaattagccaggtgtggtggtgcacgcctgtcatcccagctactcaggaggctgaggcaggagaatcacttgatctcaggaggtggaggttgcagtgaggtcacactactgcactccagcctgggcgacagagtgaaactccatctcaataaataaatgaattaaaattaaaattaaaaaatgaaatgtaggtcactacttttctcaaaggcctgctcatcttccttatcctgagcaatatcatcactacccactttgtcacccaagctgcagtcctgggaattgccttcaatttccctcacccttcacactgactcagccactaagtactgtgtgctaagtttgacagtccatcctgtgctcactattctaaatatcgcagcattaattcaggctttcattgttttttcgcttgaatattactgtaattgtctgcacaccatgtctcccaaatccgggcttggcttcctctgtatcattcttgtgaggctgcctgagagatatttgtaaaatgctaatcggaatatgtcccctgtcttgcctgcaggacagagttcaaacatagcagcatggcataccctccttgacctggtcgtggccaagctctccagatccttcctttgtgactctactcctcctcccactttgtaatcctgccatgtgaagatttactgctcacaaatgcatctctctatttccaggtctctggatccttttttgctaaggctttatcttcctggaatgccctttcccatgctgtcaaccaggcaaattcccacccatcctgcaagaggcagctcaagcacttagtcctctgtcaagcctctcaagtaaagctgctgcattgctttcatgtcacagctaagctttgtgcatccttctcttacagccctttcataatgtattgcagtttttttacagactgcagccttcacttctagaccattagctccttggggacacatgcctgctctttattgcatgctcaggcccacacgcaatagtcaacaatacttgaacaagtgaattagtaaatgaaaccaattgtatgtgtacacataatcttagttgcaaataatttattttaaaagcaaatcccaagagaatgaaccaggcagaaacaatgaggcaagaatagatcatttatctttgtaaactctacgagagtgcagctcaaagtgtaaggctgaaaacaacatttagctgttgtgtaagtgtctgcaggaacatagcatcctcctctcccaggcctctcatcaataatcttctcctaccaccaccgcagccatctctgatcctgggcaggggttaagtacagaggtgaaaggaaaagggtgaagatctgtatttaatagcctatttcctggatccctagtctctgaacctagtggagagaatcactgatactcaacctcaagtttttggtgaaataaaaatggtctaaaccttaatagagatgattcttagtggagagaaatctattaaggtctaaaccttaataaaccttaatataaggtctaaaccttaatataatgttaacaataaatcttaataaaaggtctaaaccttaatagagatgattctcaggatagagcagaatattccatgtatctcctggattggctaaagtggaacagagcaaaaataaacgtttttcagattgtgctctcatttctaagatgcaggacaggaacgtgggcaaatcaatagtcaagtggtgatgctgtcacttttgaatgaagaaactaaacaaaggactggggaaattgacaaagatgagtatggctgcaaagcacagtgagagaagaaacttgacgtctgagagttgagtgaggggctgagaaactgtaggcaggaatacccacttcaccaatcactccacgccacctcaccaccctgggccacacggtatttaagtacaaggcaggacatcagatgacctaccgaaagtactccttgcacagagaagaaagctgactacggctcttgccagcgcctactctacatgaaggctgcaattaaacagctctccctggaataagactgtggaaagaagcagccaagtgcccccctgagacacacagaaaagcaataactatgttgacattccaagaagagagagggagaagagcatttttcttgcagtctcattctttaattgcctcttctggcttcctttctggagagagaagggaggtgggtgatggcggctggatcatgtaaaagaccagagtgcagctgatgtgaacttctatcaggcctccttgcacaaagaccttattataatacacacataaaaatgcgtgggcaagtcttggagggttgaggtttttccccccaaactcactcccagccccgtgctttgaatgcagttgtgtatacacaccctctgacagaataggttcttcgtgttgccatggagctgaaacctctgtagtttagatggaaggatcacagtgcttttatacttctaacagcagaggtaagaatcactgcataatattaactccacttttatttcagattttccgttgctcatcttcgtattctgcgtgaactctatttatatttttttactccttataaaattacctcatagaagctgctagcaaactgattcttttctttgtaaatcaatatgtcaaaacttgagtgcatacatgatgtgtgagttttccccactcctgccctttttaacagagaaaatttgtgaccttatcacatctaggggagtttatgagaaatgcaaagtacaaatcaattcatagctaataaatatgctgtgaaacacataaaacgtcgcataaccagtaagtattttctctgatatgataaacctaaagattatttatattctgattactatttttcaaataggtttcaagaatcaaaatcatatctagaacgcttttgcaaacatagatatgcttctgcaagttcctctcagatcttgtttcaaaacttagctactaccctattgtttggaaatcaaataaaataatcaaatgaaagaaaaacaaagtaatttcctagcacaacctcaatgtctatgctgcccctccttttcagattttgtacctcctaagaaatcagtgatttgacttctgcaaaatcaaatgcaaaggagttaaataaaacaattttgatttcctacctggaaatatgcttttggtcctatcacacattctcataatcttgagcctcaatgtctcaggtaaattcgccaatctgccgacaagaagttttgtattatgacttctcctcccacagtgcatgcattacaacttgactacgaaaatgaccttcgtcttaaccagaacagcaaaactgaatctatcggtttgaaaaaatgagagtgcaaacatgcggaggaggaagaggcaaaacaggtggataaaatgttgcactaagctacacacaatattagtgctagagtgctctgcaaaatgaaatcttaagaattagaaaatagtttatgaggaataaaatagtgatggcactagatgataacccaaataataaaataaatatccatgagtccacaccaaagtcaatcaatcaatcaataaaatatgtagatatttcctcccttcaaagataaagcttaattcttctccccttaggtgtgggctgacttccaaagaatagaatacagagagagaaaaagcagtaactttacaatggaaaaacctggcagagtctaccataaccaagtgatcaaagttaatattaccagtgataaggcatgttgatgtgacacaattcctaacataatgtgatgagatgggaacctcgcctggtggtattctgcccccaaaacccataagcccagactacaaaattcctggcccatactcttccaaaatgtcaattccatctgaaacaagtagactgtgccatggtactatcatattgtatcttgtgtcatattaaatatttttaaagtgagtagctaattaataccaaataaacttctcaggcaaaccaaaccattctttaaaacagttaacaaccactcaaatagaatagcctttttaagatagtaatattgtttagataggaatttttcttcttctcttttgatgctttcagaacacctcagtatgacatcttcaaatggtgtacacttcagttttttctttgctaaagacagtgtgtatatttccactatgactagcaacaatggtgcttgtattgattgttctggcagctatttaaataggcttgttctctccctatctcaatggcctcacaatgctgatactacaatgctcaggaacttctgagcaccctagccagatgccccttactgcttgtggacaggcattccccagcctcttggctgggtgacagcaaccacagcagcccacaagacgggtggagaaccaatgagtaaaatgataaacatttgtgatgaaacaggatgttggagacaggggggtgaggagacaaaatatctcaacgctgaactactaacgctactttggaactcctaacagtgttcccttgttgtaaaactaggagcagtaaaccgatatttttctctggtgttttctcctttattataattaatttcagaattactgctaaacaacacaccattacccaggcacagaacttaagactgagctaactgaaccacaagcactatacccccataaatattgtaaatgttcattggagacacttaaacaattatgtgaaaataaaatgttttctggacacagaacacaacattttcaatagttcagcccttgctgttgattgaatgtacactttaaaccaccatttcccttcttatctatgccagttagtaagcataaatttaagaaactctgaaataaacatagtacttcacttatacagtgtcctggacttggacttcactttgatggactctcagtatgtaagtaaatatctcttaagttgaaattctattgaaactattccctgatttctgtacttggagtacaatcattttgttttaattgctatgtattgaagaatccacaaaatattaatgttataactatgttataatactaatgcattatgcattcctgctcgaccccataaattaatgtaccagtaccatatatgcatatataccagtacaaaattgcagaaaaaaaatgactccggtggttcccattaattcacacactaattctgatatcaaggttaacaaaacaaaacaaaaaggtgaaatcaccactatggtggtgctctcttggactcctttttaaagagtgttatcaacaaggatgtcttcttagagtctacgatactcatttctctcatccatttcattcttgctttattgctaatgattgcaccaaaacaaagcaaatgattgcaccaaagcaaaaaaaaaaaaattccatcttagtagcaatttgatactttaaataaatctctgaaaaccttttccaccagaagtgtcctaacagtgacagatcattttgcactatatacacagagatggaacacagctatgcactgaggaatatggagggggcaggaagtgactgagatgcagcaagctcacttacctcagactaaacacaaaacttcatagcaatattaaacccaaatttccagtcatttttagacttaaaaacccaattcagcctgtctgaatttcaactcgtatttggcaagtacctccaaatgaaaaagtgggaaattacaaagatgaatttgaggacacacattctacttttgttccccacttgtcacacttatcctccccaaatattatttacccatctgttttatacatttacctttaaaaatcatttccggaaaaattagtaattaacattttgaaaacaatgctagagtaaaaaggttacagtgtcacatatactttcctttaacaatgtaaattacatagttccttgtaaagctgttgttcatgttgaacaacaggacctcaaacttgaaaaggcaaaattaagcctatgagaaaacacagtaggtgcagtatcagaggtgaatgtgacatttcattccaagcactattgcacacacacaactgataaatttcctaccagtacactcaagtctaaatcataattcaatatggatattagtccatactctttctgaatgaaaataaggcaacccaatgaaactgatgacatgatcaaaaaaagataaacagccctttttaccctttaaaagaacaaaggaacataagaatatttctattaatactgatattttaaagcataacaccataacctatattactcagcaagatcagtttattatccatttgttttcatttatcccgaagatcattcttagtctttctacttgtatcagttcaatttgttatcctcacactattattatcagttaagtaaccctgggtaaactgtggttttcatatctattgacctgggataacacaggctgatatgtcattagcataagcttgtcctaacaagtatgactcctctccttttaagatttgttaaaaccgacttaattatattttcttaactatcttgatgatttgggttgcccacttactttataatattttggatattacaatttatctttttaaactaagggaaaacaacctttcattcactttttaaatccttcctccattgtatgaaatattggaagacatattgaattcccatctctaaataagagttaagaaagatactgctcaaccatctaccaataaactattaccagataacttaggttattttaaaataattataagatcaattaaaccaatataaagaaaatcttgaaatgcactataaattccaaaagtgcatcctgtttacacaataagatctgagcctcagaaaaagaaaaccaacaaggcatgatttaggtaatcaatacgggggcccactaaaatgatttctgcaaacgaccggtgagttgagctcacatttaaaaatgtactattacttacattttaaaagcaagacactggaaagtagtgttacaaatgctcaaaagctcatggaaaaaaataatttccaaacatggagtgtttttcaagtgtttaataaatataagtatttttgtttttaaaacctgaggttaaatacaattcttaatttactagccagattcactgtactcagaaattcctgcatatagttttcatttactgtctaatttatcaatctataaatctacatttaatctgaaaaaattatatgacataatagaccctttaactattaatggttcaaactgttaattccccccaccatggtcatggttttagaatatacaagtccgtaagaatccaagccacttgacagtagaccaagaagcaacataaaaaatgataatcagtccgggcgtggtggctcacgcctataatcctagccctttgggaggccgaggcgggggcggaccactggaagtcaggagttcgagaccaacctggccaacgtggcaaaaccccatctctactaaaaacacaaaaattagctgggcgtggtggcacatgcctgtaatcccagctacttgggaggctgaggcaggagaactgctttaacccgggaggtggaggttgcagtaagctgagatggcaccattgcactccagcctagttgacagagtgagactctgtctcaaaaaaaaattaataataacaataatcagagaacaacactatctttatcactgtaatttttaaataactttgaaggcattcatgaaaaactaaccagaaacagataatctagattaggtaaagctaatatcatttaaatgtgcaaaataacaaaacgagaattaaatcacattgagaaatagtagaaccaagtagatataaggtaacaagaattaatatttaaaatatataaaaagctcatagaaacttacttttcaaaaaataactaagaaataaattagaaaagatatgccaagtcaatccagacaaagaaatgtaacaaataaagaaacctctttaattattattaaaatgcaaaccaaaacaacaatgcagtcaaaatttttactttggcacaatcatgataaaaatgggaagcaatttgaaaatgaggaccatgtatgataaaaaatattcattccctttgaaaaacaaccccaaaagaaaaaaaaatgaatattcagcaataaggggatttttagaaaattgtcaccattaaattagatcaaaaatatgcagccattaaaatcagaatatggtaatatgcaaaatgaaagtgtttataaaaatgattttgaaagtaaggattgtatcaatatcatgattataactatttcaagtgtatgaatgtgggcaaagatcaaagaatatacaaggaaaaattctaaaaatcaagttgatacattataaaagcctataagatagttatgcatcttttctttattggtgatataatattgcttttgtgataaattaaaaacttgacaaaaacaaataaattacagcaagctagtcagctccaaaattaaatctcccaaatgcatcaaccagtacctaccataaaacaatgactgttccacaggagagttcaccaatggccagatctctgtaaccaaagcaagacctacatcttacatgaaatgaaactgtgaatggtccgtagcatattcatactctttaagctattaatccatgcccaagtgcttaaaaagtttactatctagcatatgatgttggagattgttcatttctatccttgtgattgtactacatccattatttctatgggagttcagtatacactaccaaatcacattgtttgaatacaggcaattctcaacttacaaccacctgacgaaaaccaaaaataaaaccagctgctgctttccccgggttgtcgccttctagcactaccagtagtcttactgttacccctagagagtctcagctgttgtgaagaaatctaaaactttttagagaatttgggggaagaaagggtcaaagcaataaaacagtaccagatagtgaatatacacaaagcacacaaagccattgcttaccctgagtcgtactcagtaaaggtttgatgaatgaatgaataaatttccttttcacctctgtaatttgagccccactactttgcctctaccctactccagcagcctgttaacaagcctccttttggggctctcgattcatggagctggagctcaagaagggagtgaaaccccataaacaaacagctgtgatcaacaggctgtccactgggcaattcaacagagaggacctgcgctcaggaccaatccaaaaacgtctgttcttgtgacctcccctagagcatcggtatgatgtatactccaattgtactttgatggccttaaaggagcagaaccactttaaacatatctaaagtctaataacttttcgatttatttcaccccatgtatttctaactaatctttcatcttctgaaatttcaagccactccattactcaaaaatcttcctcagctctctcttaccaactgaattacagaaaatcaaagaaactcaaagtttgagaggtctgaaaggacttttagcacaacaacctaaagaacagggcaaaacaacttcactctttcattcaagttccatcacaacatggtccaggccttcctacttatgattctcagatcctaaccttgtatatttcccatctcctgactttcactcatgccaccatttatatcatactctatttgaatggtgccctcacgattttacaaaatccaactcttgggcagccatatgtggtgttcctactttcacttgtaacatatgtccatcttccaacccatcgctgcttctaaagatgttaaccaatcctcaaggtccacattttccagaaaaacctttcctggttcatgcaattggtctttttctctgaactttcatttcatctggtttatgcctgttttttgcatattctgtcttttccagtaaaatgagttagtcatgcttgccattaacaatattagattgcattctctctgagaacatgatgtagggttcacatttatttctatatagtttctagcccattgccaaaatcagaacaggtactcaaataattgttggctgggacctttgattggtaagaaaatacagatgactttggaactagaaaaatttaaaggagtgatttagactggaatggactatagcaatcaaagaccaagaactaaatttggataacttggtgccttcaggttgactgggttgagaagggtgctaagtggtaggatgtcactgtcaaaaacatacttttccctatttcaaaattttgccttagaccaaatatgtacctatggaaaaagacttcctctcatcttttcctccactctgtaagataccacctctcaaaaaaaaaaaaaaaaaaaaaaattctgaattctacacaacgaattaaaaacacagttttgaaacaaagtacaaaggaaccaagcataatttaacctgttttgtagaatatcaaaaataactttccttttttaattaacaatagtctattaaagggcagattttagggatacaaatctgaaacacttgaagagcaggtgtatcattttagaggtatctaaacgttattgtctctactatatggagcctgtgtgtctgcctaacacataacatgcattttcttaattagaatgcatgctgaaatacctattttaataaatatatcatgacccaaggaaatcattatgatctattaaagaacaattaactataaaagcattagctatacagaaagagatagcttcaaattggtatacacagatttctactatctatagacaaaaatctatctgaacatttttcaagaccttaaaagatgctgtgtttacatagcaatggtatagtatacattggcagatgattcaaaatattttagtatatatctacatatatgagtatttataatctgaaaattaaatcccatgattttaagacaatttaaatataaactaggcaggggagagtgcagcagtgttagagaggaggtcactgaggaatgaatgaatatatattaagcatgtttaataaggctttatacaccaacattttttgagattacatatatctaaaatgcaaaaaaaccaactgcctctgtttttaatcagaaatatctcagggtcattatcataaacatagatcaccatagcaaacctactcatttatttatttccatttactaggaaaatacttagggagcctcttctatgagtcaagtacaacattaagtcctggagataacagtatcatatggggcaggcatggtctcagccctagtagaacttagattctgagtagaaagatcaaaaaatagctactgtaaattgggggaaacacagtaacagcttctgaagctactgagatgcttacatttgcttacccctgcactcttgtttcctccagtggcctatattttgatctttaagatcttgcttctgatttttatagtttatctatttccttcttcactttcaggctgtcagtgattacatttgcagtcaacatgccatcctttaccagtgacaatgtttgacttccatatactgctcctaatctctagccaatcagatcatcaagcctattaaaactaagcctaaaataaggacaaacaagctctgagtgaaggctgaataggtattttctaccattgcagtttgataaaatcatttcatgcattatccgtttctttctgatgagatatttctattacccaactgaccatgccacccatttaagaagataatttaaagaaatgttttaccaacaaaatttcccactcttctctcattctcttctaaaataaacaaaacaggccaggcatggtggcttgcgcctgtaatcccagcactttgggaggctgaggcaggcagatcacgaggtcaagagattgagaccatcctggccaacatggtgaaaccccatctctactaaaaaacacaaaaattagctgggtgtggtggcgcatgcctgtagtcccagctatatgagaggctgaggcaggagaattgtttgaacccggcaggcagaggttgcagtgagccaagattgtgccactgcaatccagcctggtgacacagcgagactacgtctcaaaaaataaaaataaagataaacaaaacaaaacaacaacaacaacaacaaacctacacttctgcttagaagcaagatccctactgccagaaaagtcttctttaagtacagtccatagaaatggtatcttaatatataaaccactgtttctcaaagagtagttctcagatcaccggcagcagaattacctaatttacctcttaacattaaggttccctgtgcctcacctcagacctagtgaatcacatgcgtagagcatgggggcctgaattttttaacgctccttgaaagaccatcgtgcatgatacagcttgaatccactgatctaaataaccaaagagtacacattgaaaatgtcagtctgagccctaaagactcaagtcctctattttactaccagtctgcaaaatttaatgaatgccaccctctgcaatgcactggataaaattaagtttaaaaagttcaagacaataaagtttaaaggtcacctctacccagagagtttccactttaatatggaagacaaagcacaaacacattaaaaaaaaaaaaaaaaaaaaacttaaaaataagcacaaacaacatttcaggggagcccagtgaatagaggacaaacgtgctgagaggggcagagcctaggactgaacagaatacagttgggattcagaaaggaagaattctaaaacaagtttggggcagaatttaaacatagcaattttcaagtgggtctctaaaaaggtgtgatgattgccatagggcatttaagatcaaggagaaaatatgtataatcatatctcttggtaccatagtcaacacagaaagagaagtgtcctgcaggcttattaaaaagatgagatattggtttgggaaaacctccctgaaaagaaggttttataaacatatattatcttttgaggcagacagaggaggtattgttatccccagatttacagacgaggagactaagaatcatctgagacccttttttgcagggttcttattataggacaaagctggtcctttccttccatcagggactctttgctcagcctgacactgctcccaggagaaggatcattaattcactgtctcagaaatgagacaacaagccattcaaaaacatatttctccctctgtccagttcaagaaacaatcaggggaaatgtgtgtgagtgtttgtgtgtctgtgatgcgtatgtgtgcatgatatgtgtgcatgcatgtagatctatgcatgagtgtgtgtgtcgagggtatcactgactaatttaactgaccgctcatcatttcataattaatgagttactgtattttagtgtctaatggatgtttcagtgctagtacttatggctaatgatactgaaaagcaaaagccaatcaaagtctctgactttgtgatttgatttgtgatcaagataattatctgaaatctccatactgggttagtgacagcaggtttcctctggctgtgctatccagtatggtaggcactagccatatgtggctgcttaggtttaaatataaaattagcattaaataaaatttaaaaattagttcctcagctgcacggccacatttcaagtaccccaaagccacttgtgtttagtggctaccatattggccaatgcagttcaattggagagcactgctccagagtgtcagtctttctgaaaagacaacttcaggcctcagtgtatacaaccattgttatttacatctagttccaaacacatgctaataacagtgatcgaacttttgtccctcccactaaggcttctcaagcccctctagtagaattcatatatttctcctcagaaatcccttcccccttctcctcatcacacctctcttctcgtggctgttttcatcctggcttgatagctacgtgcacatccatctcctctacagtcagcttctcaaggccagtgggtcatgttcagttaccagtaatggtccatggccttttaggaaccgcgtcgcacagcaccaggtgagtggtgggcaagcgagcattactgcctgagctccacctcctatcagagcagcggtagcattagattctcataggagcgtgaaaccgactgtgaaccgcgcatgcgagggatctaggttgcatgctccttatgacaatctaatgtctgatgatctgaggtggaactgtttcatccggaaaccatccaccatccccacaccatggaaaaattctcctccatgaaactggttcctggtgccaaaaaggttggagactgtgagtttaaagaatggtaaggttttgtgatcattcctacgaggtagatgcttaggtggaattattgcttgtgctgcacatttataaggagaagaaaaaatcaaatgattttagaagtgggtatgaaaatgtacttagcagacataaatcagaaaagcactgggctgtattggaggtattgttatccccaatttacagacgaggagactaagactgtcatcagccagcacacagaggatggccccttaccacagcagggagacaaaaccaggactcatggtgacctatgggaaccgaactgcttagcttaggatgagcttgtcaaaaagttgtatcaattcatttcttactcatgctgttacaacatcttcaaaaactcaagccttgggatgctaatgagaacttctactttcactctgacgacttctgaaacacgaaaaacgtacatttccttcatgctatcatttggatagtttcaaagtacctgaagtatgaacaatatctgattttttcaataaaccagtttgagggggaaaacccatggatcagggcacactggctgtccccatgaagacagaaaatactaaaaaggattgaagagttatcacactggtacttcactgctcactgctttcttttgccagcttcaatgccatacttaactaagtatctaattgccatacttaactaagtttctaggcactttcccacaagccttggaagaaagaggtgtctacagggccaccatagaccagaggaaaggtaaaacacgggaaatgaaaccaagtaacgtggtgagagcacaactgatgacaatcacagagagcacagtcgactgcagggggtgctgaatgtggccttcagaggaagtgaaacttagaacagggccaaagatgcatcactttccacaagaaaagtcacccactcttgccccatcctcacctccacgccatctcgtggctcaccattgtggcatttcttcatcgtcaacattccagattgataaaaagtagtaaattaaagactggcccagcaaagtccctgatcagccggatcaccagcagcaagttgcacgtttgcacgtgtctctcccaccacagtgtaccgcaaaactcagtcaggttagagccctgaaatattatcaggctctcagtatatgaaaaaaaaaaaagtgcctgagatgtgcttggagattgcagtcatagtactggggatgggctctggcagcagccccttgaagcagaacctgagctaacactgcgtatccgtaggtaaccgtgggcaagcaactgacccttcttggtgcccccattttctcacatgtcagccacagttatcatgtgccatcaaatttaagtggtctaccaattctaagacataagcttttttttcatattttaacatttttgaaatcagaatgtgtcttactatggatggcatctttcaaaaaaaattggaatctttgttttcctttcttagaggtacatcaaatgccatcttacaaccgatgataccttagagtctatgaaatttggagcctactttataaagtatcgataaagattaaattagttaatttaggtcaagtatttagaatagcggttggtcttgagtaagctgctcagtaattattagtcactattaaatttatgactctgaaaatgggcagagtcataacagacaatcaacacatttttactcataaactgtgtgttaaaatgatggctgatgcagaagtgttgcagggagaggttaaatgactattcaaaacctgatgtatccccagcccttggtgcatagtagttggtacataataaataattgttaactaaatcaattgaatgcacaacccagccttactcatgccaaaagtctcttcatcaaacataaatatctaatattctttccatacaaagggaaaccagcaagaacatggttcttttatgctaagtgacaaagagcagattcctactttttgaaggctttgaatatttttccagatgaagacttcatgcaggttttcttctccggtaatgccctttctacctcaactttccacaaatttaaatcctgagccccttcttttaaggcccaattcaaatttcatctcctctaagaactgtttttccccactatttctcccccatttaatcttctttctattcctactccttacatttacctcagctaccattaaacacttaatttgaacctcactggacacaataatattaaaatattgtgtaagaatgggaactgggtcatgattgtcactgcttcccctggagagccttacgcaagagggaaatctgcttgaatcctcttgttatgtgtggaattgtggccccccaaaaagaaacattgaagttctaacttccatacctcagaatgcagccttgtttggaaataaggtccttgcagatgtaattagttaggatgacatcacactgtagtagggtgggccccttatccaacatgacagaaatggcgaacactacatgaagactgaggcagagactacagtaatgaggagcccaggaacaactaggattgcaaaccatggccagaggctgggagagaggcacagaacagatttcccctcacagccctcagaagagctaaccctgctgacaccttggcttcacacttgcagcctccagaactgtgagacaatagatgtcttttgttttcagccacccagcatgtgggactttatcacagcagccctggcaaaatctctattgcacctctcctcacatagatgctatgacactggactctcttttattatggacctctagccagcctttcttaatcttggtggcatcactcccttgaatcaggcctgtaaaagttagggtttctccagagttagccccacactctcttttcgtctctgttctctttacaccctctcatccactacaactcagacaccatctatacattaaggacacccacttccatctccagaccaccccttcctccagactcctatgatcaactgactacttggcatctccatttagataattcaaagccgctttaaactcaacaaatccaaaaacaaaagtcaccactttcttaaacctggctttccccttagtgagccccatcccaataaattgtgcctctgcccattcaggcatgcagaccacacacttaggactcattctaggctacgtcctctccttcactctctacaggtactatcaagccctatctatttctcctcctggaaatctctcaaatctcaccaatctttctctggtctccacctctacctctttaattcactgtagtggattagtctagtgtagtcatctactccctggtttactgcagtaatctcttgactagttctagatccaatcttgccaccctccaatttgttcaccatgcaaagctcaactacatagtccaagtaaatttcaaaatgcaaatctaatcctttcatccccatgtctgaacaacttctatgggtttccattcaagttgggatgaagaccaaaatcctaaactgagtttataagaccctgtgtggaccaagccctgtgcagctcccttgttcttggtgctccagccacagcagtgttcctttacgcctttgattagaaccatgatcccactgatcacaggtcctgtgccctagctgttccctccacctggagaatccaccaaccccttcacttatttaatgctccccattagtcaatttgggctcaagacatccgtttctcagaaaaatctttccctgacttcatcaaagagatgaagctctcctgttctcctctctcctggcaccttaaaagcataatttataattataagagtaggaaagaagttatcaactaatttataattctacagctgtatgattgtcagattaatatggattagggtcctccaatgaggactgaaactctttgttcctgctgtatccccagctctcagatcagcatccagcacctaacagctactcaataagtatttgttaaataatcaacagtaagcaaatatcctttacatattgaaagaaactactgttttaattgtataccatattatgatggaaattatttctctagaaagatacatacagtatttaattttcctaaggcttctactgtagcataatggacatactataaatgtgacaggctggtttactgtatgttaactatattttaaatgcacttcttctaatattgtactgttaataattatgctgccataagcaattattaacttatgtcactcatccaaaatttcaaaggtgattagttgataacttctttgctactcttattccaatagtccaaaaacaagtaaataaaattttactaacagtttcgtatgtgatgtactgttggttttatcactaattctctcttctccaggatcatcaacctacttgatatgaaaaacagaatacatgaataatgaaaacaaaggttatatcactccaaccctattaaacaattttcctcaaaattttctgagtgcagatcttggtacagctctgcatagggacagtgacagccaccgcagcagaagcaacaggtatgaatgacatccacgtgacactacatgcgctgcaagtggcaacaattctgagtgcatgtggattccaaataacaaattttattctcattaacagtgatgataaaaaatataacacatatttctaaatgatgggaaaacattagtatttcctaacttatttcattaaataagaatcttataaacaacttccaatcacacatgtactcaactaccaccaaccttgatacagaggagtccaaagtaaagacagcaaagctaatccatatcccaaataatcatatctgagtattagacacagaaattctgctcttatcagataaagaaagtagcttcacacaccttctcaaaatcataatatgcttctgtaattttttttttttgagatagagtcttgctctgttgcccaggctacagcgcagtggagcaaccttggctcactgcaagctccgcctcctgggttcaagcagttctcctgcttcagcctctcgagtagctgggattacaggcatgcaccaccacgcctggctgatttttgcatttttagtagacaggttttgccatgttggccaggctggtttcaaacttctgacctcaagcaatccacccaccttggcctcccaaagtgctgggattatagacgtgagccatcatgcccggagcgtctgtaattttaacaagaacaatgtgagccatgaaatgaaactacaacagtctctctacttcagtctcaatacctttttccttaaaccctttcctctttgcctccctatttatttttccctatttattttatttacttttatttatttatcaatagagaccgggtttcgccattttggccaggctggtctcaaagtcctgacctcaggtgatccgcctgcctcggcctcccaaagtgctgagattaaaggcctgagccatcgctcacagccctatttatttttttctattaaacgaactcaagagttaaaattacaacagcacccagagagttgccacgaatgtggatgcggcattcttctagctgcatcctcctgggtcttccaccctaaagctttaacagaccgcgtgcctcctaacgacagcatctggatgttctgccctggctttgcgacgctgcaggcctgtggctgtttcagaattgtctccccaagattcatgcccatgagatcatgccaagctgacctcttcagaacgtgataccctgaagcacagctgtaaaaatagagcactccataacaacttcttattcaccaataaaaaacataatgttctttcacttttagggaattaacatgttcatgtaattttttgaagacaaggtgaaataaatgaagaaaagagccttaagttatataaatgtattttctcatgacaaaacaatgtaaaaacaaacacaggttccagtaatttagaaaaagtgatgtcataaaagccatgtaaccaagtctgaagtctcaaatcattcccactataattttttaaatattaacacctgtagttaacacattcatgtttctttataatacataattccctacctattattttacttttaagtcatgcaatttagattgttttattcttaaaatacattcctctgctttgatttttatgtctttattaacttcaagttacccatctgtccatttctctaccaaatttaatgacattttcatttactcacactggctttcttaattccagtatattttcagtgtgttcttattttacagttacaaaaacacaagcagaaagaagcctcaaaaattatacagacctttgaggcaagtcacctcaactttcttttttaatgaaacagattgaaatgaaagtaaaattagaaaacaatactgttaaatgccctttatgtgaaatatacaaaatattctctgctctcttcctgatagttgttttcttcgccagtttcagagctttatagtttaatattgactcataattgtgctttaaaaattaaaaagcaaatcctattatattcttattggataggtaaggaatgtattttaccagctgcagctcacatcaggaaccgtctataaatgtcttctatgcaaatctagatccacagtaacaggctcaaatgcaagccatttttttcagaatcacatttcttttaaggaaacacatgtcacaatgcagtttataatatgggtaagtttatcattattctactcaaagacccacttttataattattctcttacttgccttctacaaataaagtccatgttcaaacctattaagctttgggaaataagatgtaatatacattatctatgcaaaaataataaaatggcattttaaaatactgataagtttattgagttaaaaattgataccctgacatggatcttactctgttcctttcacatttagtgtgctattctctagtaatgttaataagttgtaaataaatgtaagcaaactctacattggtcactgatgtgaaagagcaaagaattagtcctcaaaggaggcagaaatgttaacctattcaaaggatgtaacaacagaagttgaaaaacactttgttctgtataaaaacagagcttcctaagtatatttttatgtcattagacataaactctttaaaagtatttctacagtaggaaagttggttctatcaaatttaattattctgttcactgtaaagacacaatagttggatctttctataagcctaacaaacatttcctctaccactcattttatctccaaaggtaagaattacagtcccattttgtgtaactgctacatgaggtcacagagttatagctaaaaagaaagtcacaaatgtaaggataatatcccttctatcatattctgctacttatttgtcactcaattatctttgtatctccgaagtcctggcttccaaaggttcggcatgcagagctgaccttggtctagtcctccgtcacatgtgagtggctcacggcttcactttgagccctacccatggtgtccactcttgtactatccagatcacaggtatgtattaaagacctcctctctgacaaccaagaccccatgattcttattggatagcaggagggagaactcatttggaaattccctaatttccaggaaatcaattcctgaatacatcctgtgcttcaagaatttagaaactgggttatcacataggtaacagaagaataaacttctctgaagaaaataaaagggatgaggtacctaccaccaacaaggagataaaaaattttatactcagattgactagtctggattaaaaatttattaatccagctgggcatggtagctcacgcctgtaatcctagcactttgggaagctgaggcaggaggatcacttgagcccaggagttccagatcagcctaagcaacatagggagaacccatttctacaaaaaatttaaaaaattagctgggaatcggagcacatgcctgtagtcccagctacttgggagactgaggtaggaggatcctgtgagcccaggaggtagaggctgtagtgagctattatcatgccactgcaatccacagtgagtgacagagggagatcctgtctcaatatacatatataaatccatctcttttccccaatttattcattcattcacccattcattcagcaaaagtatacagagctacagtaaggaagcaggtcatgaaaaaggaaagtctgggatttgaattaggactgccggagcttaaatgcaagctccaaaacatactagcagtgtgacaagatatttaacttctctgcccttccaatgttttcatctataaaataagaagacaaacagccctgcctcaaaaaaataaaaagtttaaaatatgaggataggctgcgcaaggtggctcatgcctgcaatcccagcactttgggaggcaggcagattgcttgaggccaggagttcgagaccagcctggccaacatggcgaaacctgtctctattaaatatacaaaaattagccaggcgtggtggcacacgcccgtaatcccagctactggggaggctgaggcacgagaatcgcttgaacccaggaggcagaggttgcagtgagccgagattgtgccactgcactccagccttggtcatacaatgagactcttcctcaaaagaaaagaggataacacatgtaaaaggcctagaaaagtgtctgatgttcagttttttttaattatcattatgaactaaaaatcccatcagattctgaagttacagtgataaaataaggctctattgccctatccctactgaggattacaatctaagtcaggccatgtattaatctcaaaccagtagttaatcctaatctgaaataactagggagaaaaaggattgtcaaacttcttttggaaatctaggacttaatcctcctttagtcagaaactttgggatctaatttaaatgccttctccacacttccaaaaaatcaaagcttaaatagtcaatcaccctaaatagcaaatgacagatcaaactacatgctggcaatttcctaattattaatcacttttcagttcttatcttactttaactctccatagcatatggtattgatgcttaaagtctctttggggaaactcaacttcgttggcgtctaagacgtgaccctttcttcatttccctcctctctgtctagtccacatcctcaggatctggcctcatcttacatctctatcccatttttcacaatctcccacttgtcctttaaacttcagccatactaagctctttaaaattccccaaactcgctatgcattctcaaactctcaccaagctgctctcagtgtctattgatccttccaaaggcagctgagggaatgttccatttcacctcttctgcaaggagggtttagggctccctccaggcccttcttttcaccctctgcttccccctacttttgcccttattccaatatcctaattcttgaattgcaagtcagttccttcacttgactatgatgtctttggggatagcaacacaagctctcaattcgcatttaataaatataaataaccacataagtatacttctaaaattttaaaatagtaagatccagagtggcctgaacttcatttattgagtgcttactacaggccaggttctttacatatattagtacacttaagcctcataaggtctgttttaagaggtatcctggttttacaggtgagcaaactggaggctaaggggataaacgtaacttgccaaaagtcatacaactagaaagtaactgagacagtactcaaacccaggcaggccagctctgaaacccacagttctggtcccactctatactgactgcctcttttccagtcgtaagtctgattaagcaacagaactggctctcaataagaattatgacatgtacatccctagagagcctcaaaaacagatttttttaaaagactgtcttgtcccctcctattattttgcaggtatgagcatgtaaatacatagtatttatatgaacatgtattcatgtaaacacatagtactctccagaaaacaaacatgttttaatataaatcctgcccaacatctaacaaactattatcaataaatcagtaattagtaaataattataccactaataagagataaatatttcatagttaaatatttaggccaggcgcggtggctcatgcctggtaatcccagcactttgggaggccaaggcgggtggatcacgaggtcaggagttcaagaccagcctggccaagatggtgaaactctgtctctactaaaaatacaaaaattagccaggcatggtgtgggagcctgtaatcccagctactcgggaggctgaggtagggaattgcttgaatccgggaggcggaggttgcagtgagctgagatcgtgccactgtactccagcctgggcaacagagcaagactccgtctcaaaaaaaaaaaaatcatagttaaatatttaatagtgaacaataagataagcatgaaccaaaatataacagatgacatttaaaaataagatagttaatgctacctattacatttcccatgatgttagctacagtctcctatgttccaaccaagaggatatattgaacactttggagaagattttctttttcaaaaccattcatatttgattccaaataatattccaattcagctgatatattggatggatcccaaacacaccatctgttttttattcagttgtaccttagcaaggcagagaaatgaagaccccttgctcaaaaattaatttcaagacagtgacagcagatcatttaaccaaactcagggcccttctgagcttggagccctgtacaaatgcacaggtcacatgcccacaaagccagccctgtggagcccctagattctatgtcaggcacagtaccaggcaggaggtacagcaacggcttttaatccataatcccgatgtccagaaaggctcaaatgtagcatcaaagatcctgttaggcaataaataatcaaatatgaaataggtttaagaactcaaagaatctttggatctcaaaccgctaggtaaaggccgagggttaagtgctagttaaaatgattcaaattcaagtgggcctctcttcagctttgctaaatgtcttcttttataaatcaataggtcaatgagctttttaaaaaatgactctcattagatgcaaaaggaggactgcagatgattagaatagtaaataaagcaccaggattgcagtatcatgtttctttcagtggttttttaatttaataaatgtttattgtgcatctgctatatgtttacatttcattaaaaatcaaataatatctcacttttttaaacctcttaccaaaaagagaattctaaaattatgaccgaagactacaaaatagcatctgaaatatgagagatagcagtatcatctttatttcctcattcagcacccgtgctctgagcaactactccgggtcaggcaccgttctaggcattaggcattcagagaggaaaagacaaactctgcctttatttatgtagttcattggaaaaggcatacagtagacaaccaattctttcaaaaaatactgtttaagatatttcaaattgtaattccaagatacaatggaagattgcatttattctaggattttcctccaagaaacataaacttctcagttaagaggaaaaacatcttctcctactgaccctaaacagaactatagttttggtcactgcaaaggcacaaaatttttctgcagtacaaaaggtggaatatatgcccaaaagtagatatatttgtaattcatgtgttaatcaaatcacatatgcttagactataattacagacaaggtactgggtttggattaatgttataaaaattcagaatctatgcagtccataaggacttttcacactccatttttcataaaatagtatgttaatctcctggtgattatgagattcaactaataagtctaaggatcctacttagcacctccaacatgatgctgcatcaaaactggggattattgttcatacaaatctggagtaactggtccctataatactactactaaatactttcatagtacctttgcggccacatcttttgaggccacatagttgggtcctctgccttctgtctatttactctctctgttttaaatcttatagagagtaaacagatagaatgcaggagacccaatatgtggcctcaaaggatgaaactaacatgcactttagaagttctccttgttctaccacacaaacgttccatacaattttattgtgaaggaaaaaagggaatgagaatcaatatttttagaaagtaatcttgcattaacatagtgctttctagttttatgaaactttgtcactcacataaccttgtttgtccccaaattgtttaactgtaagagtgtactataatggattctgctctcctaacataataccaaggagccacaaccttccctctattcttaatctccaattttattttcttaagtgggccactaagtatatctgtaccaacatttttgtgcatttcataacccataactttgccaccataacaacttgaactaagctcagataggaaataggatcgttgtgttatattttgtcaaggaaaaagggaaaagctaccccaaaaagacaaatttcaaaaatctaaagctattattccagatgtactcaaataaccttaaatttccttattgcataagtaagctgaaagtttcccaagaaaaatgacatcgtactatatgcacatctcataatcctatggggacttcttttaaatgagaacatttaggcaacactactgaaagcatacataagtcagcggttagcttcatgactcagtttaacttaaacatgtaaacatagtgtatgttccaatttggaatgatttttgaggtttactagaaactactaaataatattttcatttagtaagtcctttctctgtcaactctttgatgtaagaaaccttagcagacctcccagtgaactttagcattttggctgtgtgtccaaaagaacaatctaccattacaaagcctattcatgagtcaaccagggacgtaatcacaatcacgactgctcagctgatacgactcttctttatcatacctgcaagtatggaagacacgtaagattcaagttactaaattatagattattagtactaaacatcgattcttaaatatagttctaaagatgattcatgcaaatttaaactttttttaaatttaacagcttgggttaacttgcttgtgttcaactttttacgtctacctctagcaaaataatattattataaaaacagtaaaagtccatctaataatttcagtataataaatccagggctttgacactgtcttcaaattcacaagatcattagtattcttttaaaccaaattaatcatattccctaaataacaacagctaaaatcatgaacactgagatcattttcttgtaatgattctgtctggaagtgtattaacggcatgatgtttgtgctttgcactaaacattcatatctttgtttccacaacaaagtaaaaaggtggcagttagagggagagttaaacaaggtttcctgtgagggctttgtgaaaagaaagagcgtatattctatccgggcaatgacaaacggactcaggcctcctgaggtcagcgctcctgggcaccatcaggccccacttcgggagcccccggtgctccgggcccacctgactgggcgtcctctgagtcagggaggtgccagtgctgtggtccccgcgagcccaactgtcccctgacccccgggcttttccgcaccgtggagtcccccgacacgctggggccagtgaacccgggccggggcgcgcgttctccctcccggaccagctcccggcgctgggcccgcggccgagaaactaggtctgggccggccctgcggcggccgccgggcgcggcgagccccactttctcccggcaggaaggggggaggccgagagcatttcctgttgtgcagctgagccctgcggagacgtcattgcattcatgctccctcgggtgtcagcggacggggggccaaagttcaagccgcgtccagggcaggcagcgcgcggcggcgcggcggcgcggggcgggcggccagggctcccctctcccgctggcgctcccggcgcctccgtccccggccggcccagcgctgctaccggaggccagccctggggctccgcggggaagagctgctcttcctcccggaggaaaccgagctcgcaagcccagcgctcccagccgcagactgcaggctgccctcctccaccgcctggatttcccacggggaggaaaaggcgtgcgtttccaggtgtttggaggacgcactggccgggcgcactttcctcagcgtaattttgaacgcagtttccctaaagatgactcttttttccactaggattatttccaagtcatcaaaagtgaaaaatcacgtaagtgttgttgcagttgttttcccctcgttttctatctcctttccaattgtgaattccgtaaataactgtcagacataaaacaggaaaaggaacatttcttcactgcagagctccagtaaggtgaaagtaggcaagaaggccccctgagacgtttctaaaagcatattctatatgttttcattatgaaaacacccactgcactccttttatttattaggaccttaagttatcctatctcaactaatacttttaacaatcagaatctcttaagaatctttcaatcttatacttatccactttaatagccaacaaaacctttagccagagtgttttaaaatggaaattacctgttcatgtttcttaaagatttttaaagtctccttctaaatttccagccttccatttagtttcaagccataaaccagattataacaatgtgtaattgtagagaagctgtggcttacggttaataacgattaaaaataaggccataaggtattttatgatcattttgaaataaaaaattgaaatagtttaatttcagcttgtgcagtttgagacagatcgtcaactacaaaacaaattgtagattctgttctcatggtgaacaaacattacagatgttttactgtgtcaacatctctaacatttgaactaagcaatgtttcacatcaggacatgaattaaaacaatgtaaactatggacctggggtgaccatgatgtgtcgatgtaggttcttggattataacaaatgtaccactctagcgcaagacttcgatagtggaggaggctgtgtgtatgtggggacaggaagtacatgggaaatctctgtaccttccgctggattttgctgagaagctaaaactaccctaaaaatataaactctatttttaaacatatgtttagggttttatgagtatcctgatacttaaaatgtgcattgcattgtaacctatgaattgacaagaaattaatcttaagaattggcacagaaatcatctcgatgttttcatgaagttcatcctcggttctactgcttcttgataaacaagtttcatgtttagaaggttactgaaatttttttatatggtaaaggcacatcaaagactttaccatttaatatatattagttgtcctatccagtcatgtactatttaaggcaatattaaaggtaacttagatttccccacttacagtgatgcaaagcccttcaataatattctgttgtcttatttcctaaacatctgaataatacaactttatcacatgatatcttaaatttgcatagtatattagagtttgctatttgcttcacatatatatatttctatcccgattttttcaagaaataggctcagagaactgaaatctccactcagttcaggactagcatagctagtctttcaatcttgctgaaaagcaatcgcaaactcttctcattttcaaactccttattcctaactgcaaccacttctttacttcccagtggccagtgcccctgagtgtgagtgctgagaggggcctgcaaaaaatctaatcacatccaactgctttatttacttggcttcccaaactgtatcaaatgattcttgactgtaaatgtgattccactgtatccaatcctaggaaatactgtagtggatatctgtttcctgaatgatcttacaccaactttttttggggtgtcttttctccttcatatcaattgttcttttatccattaaatctctgcagcaattcttgtgtttttgatttgaacatacttatacttgttccttcaaatcatctgccaatggtatacaattagcactccccaagctgcatgtgactccccaaatactgcctaagctcagtgaagattttattcaaaattcatgctctctggtctatacctagttgctgatgatggcacttggaaaggacaaagagggaagacttaaaaatgttttattttataatcctgattacaggctaaataaaatcagtattaccataaatttagtatagactgaggatataaagatcagtatgagaacggtaagataaattaacttatgaataaatacacaattgaaaatataaaccagaacaaaaaaaaaggagttcttcaggttcctggtgctattttcaaatgcacctcttttacaccatgaaagagaagaaataactgtgaggataaaaggaagttttgcaggataatgtattttacactttctctttagaaaaaaattaaagtgctccacttttgttacttaaagtacatcatgaagtgcgcaattccaacctaagaagatatattatttcatacaatgaaaaggattaagacttgaagtttcccaaactaaccattttaaaactcattgtttcattcaggattggtttcatttaaatgtgtagttagaatatgagagaaacagtaagttgttaccataatgtttggctctccatgcttctgagatccaagttctctaactcaagagtctccacattttcatagactttgaaaagtctttgatatggccagactgtatctgacaggctgacttgtttcacaaactggcctcctctctaaaaatattcagaagggcatactaaattttcactcttctctaacaataatcaaattgagtaatatccttctcaaatgagctttcaccagtcatttgttgtttttccagaaaactgactcccaagatatgtgatgacaaaatcaagactctcttctttctgaggtccacatcctatttccatgacacactaaacgactgtgttgttcctctacagccagtactttcccaaatcaaagcccagctcaaattaaatagctgaaatgaaaggaagggagctcactgagtgaacagatatatataggaatgaagagagaagtgaatcatgcacacatactcatgaacatataagaatgaatgaaccattcatgaaaaacctacctacctacttgcttgcttcacaatctttggttcctatagaacccttttctactgtggtatctccaagctcagtggctttatttttcttacaaactacccataaaactataaccttctctttattaagtggccttcagcacaaattactaatgcctcaatcccttcaaggctagctaactaaacaaagtacagcccctgtaactgagacagtcccaagacctgcaggtggttccaggactattcattcacttctctggacaataacaagatgtatcatcacctcgtacctttcgggctgtaggtaaaagtcaatatattctcagatggaaatatatttacatagtactcaagtgtttgagagcacatctccttgttcagcctccatctatattaaatacttcagaataggccctcaatgaaatctaagtaatagttaagtactcagatggcctataatcaagcatgttattgaaacagcagtgtccccacatgaattcaagtaaaacaaaattattttttattacaatatagtattttcctattctctcctagtcactcacaaagtcctctgtacttctccagaaccaaaagtgtgactagagctaaatctaaaatgtatttatttccataatgattaaaagaaaagttccaaaatcaaagtacccactcaggaaacaataacttctattttggcaacagataattattaaatctcaactctcttctaatatatcacttctgcatataggtctacttgttctatcaaatatgtgaccatttaaatattccttctttactattcattatgtggaataagtcatctgtgcaggaaaattaagagagttttctcataggcactaaaggcagtctagagctcaagtaggaatttttttaattgttattaagatgcaacaaaactttattgtatgcgtttaaactacttgtaagactgctatctatatagtgccttacagtatgctatatagatagcagtcttacaagtagtttaaatgcatacaagtacttccaaatattctgtatccccatttttaatcaacagaaaaatataaattgacgaaaaggttaatttatactaaaatgacaatcatttgagctcagcctagtatcagtatggcatgtcatttatattgccaaaaagtaggaggtagaaaaggtatgtgtaactggcacaggtgtgaatataacaatacatccatcagcaatacacttactttagcttcatgattaaagtcactatccttgagattgctggctttctaggacacagacagtatataaaaataatatgccaattcaaagcaaacatgtcttctatgcaaaatacatatactccttgctacttataaatgcagttgaattttctgcatagaaattttcacatacttatcttttatctgttcgtttcatttcattaaattgtgtatgtagttacagaactgttcaattcagggaccaaattctcaatggggtaaattacatctaccattatctatcgttttaagtccaaaccccttaagctggaatatgagtccttagaccatatatccctatcttcctaactttctcaccaacatttacttaatacatattttatgcttccctcaaatgaaatgcttctctgaaaatactcttgacactttcccatattggtgtgtgtgcccaggtaaagcatttccttttgctatctcctgagtcctcggccagggttgatgttgcgccttctcagtacttcacgtgtgcctctctcatggtacttaacctgcttcttttaattaccgcttcacttacatcattcttttcctcagtatggtagattataaagtcctgatgatgagaatagtgactcttctttatattttatgttctacttacatttatattctatctatatttatactctacttcatattcccatatatcttgcacataccagaatctcaagaattatatttgttaaaatcaatttgcattacattattatacattccaactctgttctagttatactacataaaaagtctcagcaagcatggctagtccttttctgtaaaacgtttctaagccagttggtaagaggctgtcttctggaaagtaaatggtaataagcaatttatttttgaggagttattaaaaaaaactcagcctggagtaaatttcagacatgaacaatctgatccctgggaaattaataaaataaaaatgaaaacaacatcctatgaggtctagttgaaagaactgggaatatttagcctggagaaaagaatacttaaggtgaacaagattgctatctttaaataattgtaggattgtcatgcaagacaatgagtaaacttgttctagatagctggagagggctcaactgctggtaactagaaatgtccaagaacggaataggcctccctaagaaataaaaaggtgtttaagtagaatctgaatgcaagcagtccttggtaatttgtcctaagtgatttcttgctcagttagagattaaatgatgcctccaatagttttatctaatcctgaaattctgtaagaaactttacattgcagagtgtcctgtcaccagttgacaaaccaaaactgaaacatcagatcctacacctaagaaaattaatcagcatatttaaactagacactttaagagatgccctaaataaggcatcattgcagtaacacaaattgtatcacaatgaaaggaagaagtaaaatttctcacaaaaagctcaactgggaccgatgatgcagcctgctcaaaaccaaaagctgacctatcagaaagaaagcaatgggaacaggttgcactaaataaggaagcagtcatttgcatgttccaaaagaacctcagaatttcatttcttcatgcctgccccactcactgcctcgtttatttagaaatacttacatgtcaaatacaaataagaatagtagcctgatgtatacaactgtgtggcatactgtaaaactttgaaatgaaatttaaaccaaattggtttggctcaaaggaaattaaaaatgttagatatactgtttggcattgtttgatttttaaagctataagaaggcttagtataataatagcaggcttcaaagcaatgggaattttgtgattaatttcaaaatgtcttctgtttgcttcatactgctctcatcctacagccgacaagaatataggaaaagaaggactatcaggataatatcttcacaatataaattattgggattatttgtgaagatgtaaaatttttccagatggctattaatacccatcaggaccattttcagacatcattaggtttcacattagcaaactcccaccaaacatagccaaaaaccaactgatgactgaaaagacttggactttgtccattagaaaatttaatttccacactcagtgtctaattatttgttatattctatactgtcagattattattttaaaaggtcatttagaatattctcagccacttgacccattttaaaatttacacttgattgaagttgggcaccaagtttatcatgaatagtactaaggtcatttgaaaaagtaaacagattacaaatccaaaaacaaatgtctttagagccctttccttttgtttgaatgtgggtataactctctgaatactttgtgacacaagtgcattagtgacctacacaaaatttaaatccatcaggagatattataacaagctgtggaactgctgaccattatctttctgaaaacaattacataggcctgtaataaattgcatcaatatcagtcaattatctcaacaacactttactaacccttgtcaccaatgtattgctgtatatcagatttttttcaacaattgaattattctcaaaacttagtgttgcttcacacactaaaaatagccactctaattctcttgtgttaccctgctgtattcccaggaggtaggggagtgctataaacaatgcttcatttttacagatgaagaaataatgaaatataacagaggtacagcctcttggcctgaatccttttgaaaatcaataataaggcaagcaatcaactagtggggtcagagtttcaagtcatccattctggtgttctctagagctccagtgtaggctctaatgagcacagcctcacaagagcagaaaagatatctgaaatcctcattttacccaaaaaggctacatctctatatctctcccaacataaactttgacacatgactactgacaagaaaataaattgaatgtttataaccctggatttttcccttgcttagagaaagcgaatttattaaaatgtaagcatcagcagaagaaagaaaaataagtttgataactattccatggataattagaagctgaacttcccatgatctatccataaagtactggaccagccatcaagaccatcccaagggacattgctgagttgcaaaaacagaggctttcaccacttgctttgcatgaaaggaaaccgtttcaccccagcctttcctcctccatttgtcttggcctacatggggcaagggtgtgtagtggtggaaaggaatacactccctctttcacacctaattgatccaaacaggcacaccaagaaacaatgcttcctcaaactccacaatcatgagcaacagccaccttcacacagcgtccttcttagagcaccctgaacagaatatggtcaaagaaagctgtcctagatggaagaatcacagttcagctataagctcccctatccaactgtagggagaaacataattcaaaaaggccctatctgttcactcgctgcaaaaacaaatgggaagtttagagcctgggaagcccgcaactatgggtttaagagatgtttgggattgctggatggacacatggaggcacttgtttcctggggaacattaaaatcaaatgtgccaagaagcacttaagagtgcacagacaggctgggtgcagtggctcatgcctgtaatccccgcactttgggaggctaaggcggggtggatgacttgagcctaggagttggagatcagcctgggcaacatggcaaaaccctgtctccacaaaaagtgcaaaaattagctcagtatggtggcaggtgcctgtagtcccagctacttgggaggctgaggtgggaggatcgtttgagcccggtagtcggaggttgcagtggaggcccagatcgcaccactgcactccagtgggggcaacagagtgagaccctgtctcaaaataataataaagtaaaggtgcacagactgatgaactctggctattggcacaaagactagacaggacttgagctcctggaggatctccttcatctggttctcatggcccccatcttatagtgtggcaggtgtttttccttaccatttggaccgtaagcttcttgagaattatgactttaaacatccaccaaatatcaactgtatgcccagcacatgtcatacactgtattgagcacacttttgtgaaagtgaaaccatcctaatccactagaaattttatagcaaaaattatcagttaaaagatgaataattcacttaaacaagattaaaaatataaactctgaatataatttaactacttcactttggcaagcttataaatgcatttaacaataggatgtgtcacaaaaattagccgcgcatggtggtgccagcctgcagtcccagctactcaggggactgaggcgggagatcatttgagcccaggaggtcgaggttgcagtgaaccgtgatcgcgccactgcactccagcctgggtgacagaccgagaacttgtctcaagaagaaaaaaaaaggatgtgtcatttgtaaaccatttttttcttgcccataataaaacagccagcacttaattctctctctctctctctttttttttgagatggagtctcactctgtcagacaggctggagtgcggtggggcgatctcggctcactgcaacctctacgtcccgggttcaggcgattctcctgtctctgcctcccaagtagctgggactacaggcacgtgccaccacaccaggctaatttttgaattttagtagagatggggtttcatcatattggccatgctgatctcgaactcctgaccttgtgatccacccacctcagcgtcccaaaatgctgggattacagccgtgagccaccgcccgaccaccagcacctaattctactaattctacaggtatgaagggccataatgctgaaccataaaaatgaatttttaaaaaatctagtgctataatatttaggtgtcaaaaactaccttactatgaaatatatgtacatacacacatacacatatatataaaataaatggggtatttcattagtgatttaataagtcttacgatgtttctttgttatttgggttaagagagaccactataaaagcagagatcctgtaaacactgaaaagtaatgcagtgactgaattagccataaaaagtttctaaattagtctactagaatgtaaactccatgaaggcaaggaatttttttttttttttttactatttttgtctattgatggatctccagtgtctagaacagccctttcccagagcaggtgcttaataaatctctgttgaattaataaatttttttagaattaaagtcaacagtcctgtgaacacccaagttgagtctcttaagtaggcccaaggccccacgagtaatcactggtcctctggctcttgcacagaagttcgagtggggtaaggggtaattcaggccccaaaagctatttttagagcaaaaacttcagaatgattttccacaaagaaccagagaatttagttcacttcattggcatagcactggctgagctcagtgagaaacaccccagattttaattgatatttccatttgttaactgttaaatgtgaaaccatgtcattctaacattgtttcttaaaccatttcagtcaagagtttaatggaccatttgaaaatatttaatattttactgtcacaacaatttgaattgtcctatgtttttcttatagtctaataccttgttaataataacccatagctaccaggtattaaacgtttactatgtgctcattgagatgggtacaaacattctcataaaaatttcccaatgactcttgaatgggtattatcctcattttgtaacctcagggaggttaagtaacatacccaaattcccccaggtggtggtggagctggaatttgccctattctgtctgacttcaaatcgaggttcttaatcccgtgggctacctgtttatccatatactactaaggggaaacattgtgctaagtgataaatatggttggccttttttaaatatttgaaataattttgatgtgtaaacaattgcttatactgcgtgaaatggtaaaaagacaaagcattttcggagccaaagaaccctgagttggaatcctgcttcaccaatgactagcaaagcatccccacaaaaacctttccgaatggaagtttctttaagtatacacatcaagataaaaaactaaatcttctcaggttggttgtgagggctaagtgacgtaatgtggagagagagcctgggatggagcctggcacaggtgagtgctctttaagcctaaattgccttccttctaacggatttgctaaattggcactgtgctgatttttttaagtgtttagttcatccttgtaataccataattacagaatataatgacattgcattctctacaactacaaagtagaatttataaactgatagaatatgagctggaagaagctttaggagccatctgttccaatctcttccatttccaaatgaggtccaaagagcttcgatgacttgtttccaagttttcacagaaagttaattgcaaagacaggactagatcttgcgtccctcccacccccactcctgctatacccttcgcttttgcttcacattacacaggcatggcaacgcatgtaattttctaacaattaagcagtataaaataacctcaatttaattgcatccaattaacaagccaaattagcgtttcatatgtacactattaaactagttgtctgccttccaaaagaaataaaacactgtttcaaataaatctagcgttttggtgaacaaagctacttacagtttaaatcacctttcctataatcttctttatatggaattagacattaatctccattttaaaagaaatattttctgcaactatcaggatgagaattcacgctgtatttaagtagcaaaattttctctctcacagaacacctatggttttctatgatttgtatatgtgtgtatgcacacgtgcaaacctgtacacatatgcacgctgtcagatccctaatcaaatacaaacgaaggtgtgtccacatttacctactgccctagtttcaaaagtcccaccttttccctaggcttctgaactcaagtgaatctgccacagtgcaaataataagagcttcgatgatctgctttttttcttcttgcagagaaaatgaaaccattaaataaatctttgccaaacaaagcactgcatttcaaatacactgcactacactatctgtccagtattgtaatgatttagatacagctgggtatcaattaaaaagcagtattccagttaaccacgaaatgaatcagtggcccattccttatacatgtatccctaaaaatataattaccttgtaattttaactataaacatgtctgcaagttggtgtttgatggtcaactttcactactaatatttataaatatattccgtagtaaaaaaaattttatattaggttaaaataataatgcactacttaaaatgttcaaattgacaacctgtcatacacatttggcaatgtttaacaaaatattttaatcacttttgttacttacttttagggtacttttaaacacatcaattaacagagtaaaagaattcatattatcattcagtaggggcaactttcattacttctctttaggatattttggcaatctaactgtctccttgccaccgagatattcatcccatataccctcataagctttctgaaacacacactttatagcatcacctctctgctcaaaaaccttcagtgatgtccagctttctctgcaggtctttgaggcaccacaagatctggagctacgtacctttccaggctcccaactcttcctctgccctggtactatccctgtcccctcccatcccaggtcagagtatgaggagctcctgactcccttctttactcagtgaaattctacttaacattcaagatcctcagtaaaaaaaagaatcacctcctctcataagaaccctctaatctttccagttggaaaaaatcctgcttccatttatactctactcccaattgtaagttttaataaagtttactataagccatgtctcttctagattgtaaaatgtttgaagttggaaatcatcatccttttatctctgttgctcattctgactcttgatctgactgcagagcccaagcttggaactactacataaaatagactctttttgtcacctaaattgaatctcctacattatataaattataaaacagaaaaaaaagtaatcaaatgatgcagtggaaaaaataaaggaaagtgattttcactaacctctgtttctactcttttgcttcatattttcatatcacacagacccctaatcacatggaaagtaagaaatcagaactaaatttctccaaagatcctgatacttgcaatcatgaggagaaattattgggatacttgaatgtctcagccctttgctagttgtttgaaaatatatagatctagctcatgcagggctccaaagattaattggttacttcacacagcgaccttgtaaagacttctgaattggtagttatttattaattgaatcaatgatgctggctatttttgttaactggagcaccaaataagtatttttagaacttaaattatttgttattaaaaaaatctgcaaataataatagttaatttacaggtaagtccttcaaactgaagtcattacatatagagtcattaaaaattccaggtgctccaaaacaattgatgtggaagcactgagaagagacaggcgttatgcacaaggttcttccaatttcaaggtcctacccctcaaaattgcctctccaaggatcaacctgtaacatgatcatttggagggtcatgatgtgtcctgatttgccaaaggcagtcctcacatatgtcaggttggataatcattcctgtggtcaaccttccttcaaggccctgcattacctttctcttatcagccccactggcttgtttttaactcctggaaggagctcctttagtggttcgggtcattatttataccctgcgtgtctagcacaaggcctaatctacaggaaatacttgttgaatgactgagagagtgaattgcattgaccagcaataacagggcaccagtcgtagtactctgaatagaggattaagattatatgtgagtgacaagtcaaaaaggttggccctgggtacttcctgaacttacttccatcactctgtgacccagaagtagcaggtgagaccccctctgctttctgccgagaatcaccctcaggcacataaacatcatgttcatctcttcctctctccaaagcactttctcaaatagatgtaaacaattagatcccaaattttaaggaggttggaaatctaaagttatagacacttgtagaaaaatcacgtcatagaaaatacctcaaatgatgagtaatgggagtgtatgttaagatagcacaaattcggcctagaacaatagtgacccaaatatcaggcagttctgattctattctaaatgcagtcacgaagccagtttaggcctgtgtctatctaatgtcgatattcacggtccatctcagagaagccaaagattgcacagactaagaaacctgtgttatcctctttcccacgacgattttggagttgtgacacaataataaaatgctaaaatgttttcccaaattagttagtggcatctcatagctacaaatactggcttactcaacctctttttcataagcattgccataaatatcatacagaaagcaatgcttttgattgtgaccaaataccaggaacaaagagaaaatactacttctcatacaattactttaaaataaacatgatcttattttcataaagttttcctatttccctttaatcctctgtgttcatcccaaacactgtaaatcctacaggtttcacagtacagccctcacttgaatattcactaaagtttagctccatactaataaaggatctgcctgtatggttaaagcaaatccatacactctggatgggtttgaagttccttatgaaaccttaatttcattaagttgagttagcaaacttcctctgctcctttttataatatcactttaaaagttgtaacagttaaataccaagttttagccaaaaatatgaattcatgatgaattcacatataaatccatgaactggaagcatatcattgaaattttcaggtagatatttaaactgtgaaccgtttctccacctacagaactaatgtatagaccaacagagagttccgctgatgctgatcacataccaaaatatgaaaacggtgtttatttttaacaaataggagatgagcagcctgtctgatccacagccatatatccgattgaccttagccacttttcccttctgataataattacatgtcagttattaaattactttacatcctcatggattatagtttcactcatgccaactaacattttctatcattctttaaaattacttttcctatgtgaagctttcaaattgactttagctaattactgataataatttaaaaactgaaacccaacccaaatagtgtacttgttataattcaaaagctgaaacccaatacagtgtacaacacagagttatttgttattgctgctgttaaaatgagccctgctttgaaaaaaaaaaatggcaaattctggaataagatttttcattttaaattaaatcagcataaaagagtcaaacagatcttctgaatagtgacaaagtgccaaaagttcaagcagacacatgcaccattactccacaaggaacgtctccctatatactgtcctctgttttgttttcatggtaacaagaacattcacaaacacatctcatgcaaaggagcctgatcaatcaaaatattctgctgcttaatctttcaatgtaatcaaagagaattattttcctatgtgataatatacacatagtaaatttttcacattccatgttaaataggaatatagaaatgttttatgtactttagtggtattttaccaaacacctctacaaggatctaaccagttaaaaatcagttagatcttacatttgtaagatcattaatataccaccattcccaaaattgtccccgaatcagtcacacatcaatttactcttgaatacccttgtataaatataagccatctctaataaagttagccacataaaatacagtcactgtaacaaaaatacagatgcaaataagcaaattttgttttatacccgacctatgctcgacgcaagaaattgtctcaatgttcaaaagattcatcattgtaatacatttctgtatataagaaatatactgcatatttcaaacctagtggtcaaagggattatgacacttgaaacaaacacactatcattaagtaaatactggtaaatccctttcagctcacaatgcaaatgtacagttgtcatttggtactatgactccttagggttccacagggaattttctcttaataatgaaaatgatacccactttagtcacagaaaggacatttctgttctgataaaccatttggcctatatcctaaaaatcaaacccaatctactcattccacagtctacttcgttaaaattctgcttctggcactcttataaggtgaaaaagcaatgagacatttgctacatatgtagcaaacatatgggatctatatgtgcaaatatttaaaataacttggtttgctcaagggcaaatatcaccaaatattactatatcactggaggaaacgtttctaataaagttaaatggcctttttctaggaggacagatcattgcaaatttaattaaaatggatcttattaatatttcaagtaatgtctgggcttgattatgcactacaaaagaaacaactgtattgaggagaaaaatcaatagcccttgactagggctctgggtatgctagaaaaacacagatctcttgtgaattattgaggtccagctttagggttgggggcgagtaccaatattcatttggaggtaaattgagttatttttaaaatggcagaaaaggaaggagaaaaatcagctcaaattttccattataatgaaagtacaggaaacaagcctttctatattcattttaggcctaaataactctgcagagaataagggttttgcaatgtcagttgcacacacaacttcctgtgtgaatgctaagccattacaggtgtcctaaggcctccagtgaaacctattatcaagagattcctctggtctcctcgaagtcatccccagcgccccccatccgccgcccacacattattgcttctctcctccaagtgtcttgattaaggaccctctctcttctccgcactcccgaggttaaagtgcccccgttcccttggtgtagctagttacaagctttcccgttagggaagactagtgcctgcagtcctttttagttagatgcttttaagtcagagatgagaggagccacttgaagaaaccctccttcccttcttcctttcccccactgggaaccaagtccctgaaggacaacacccagggacgcttcctgaccttctatcccctcacccaatttgggcttggagggttggggtcgcattttctcatgtcctctgctgcactggatgtgttatgtaagagggacagaacgcgggaggcacatgcgtataaagcgcaccgatctgtgataacagctggggtagcagagcggatctggagtccaccccccccccccaccaaatacgacagaccccacacatgcacatcagcaccccctcccccacacacccacacacacacacacacacgcacacacccagagcaatgttttcctgtctcacccctaccagtaccagaggcacagaatggaaaggcggggggtgggggtgaaaggaggtgaaagaggaggaggagcagcagcagcacatctgctttgatagcagccggcagtgccgccgcggcagagagcccctcgttaacccccttcctgtggctgcaccacgtcatggaacattcccggaacgggccaacgttccacccacttcagggaacagacataaaggcgcagacccagttccccacagtgcacagcccaaacacacatgtcccttcccgatcccccgccagacggacagacaaacacgcatgcaaaccgcccccacccgtctccacgcgcccgggtccagccggcagcggccagagccgctctgcagccggtgcacccgcaaggcgagggcgcctccgcctgaaccttccatcgagacagtcccctccttcctcgcttccttccttcgctccttccttccttccttccttgcccgggaggtaaagggagtcactgaaatgcccagagccagcgccttcgctgcgctcgctcggccgcaggccggcggcccgggcctcgcgccgccagcccgcccggccgcctgcgccgcgcgccgcggccccctcccccgctacctgacaacgggccgccgccggccgccgcagccgcagcggtggccgggccgtgcgcgccggtgcacgtcgctcattagtaagcaggcacattcctgcctccagc

SEQ ID NO: 1743 - DNA, 412343 bp, Homo sapiens
  source 1..412343: mol_type = genomic DNA
tatgttgggattttcaaatttattccaacatgctaattcttttttttttaaaaaatatcctcaggctgaacactcagccagagctgtaataaaggcaattattatacttgtaaaaacttctcattcacagtacagatgtaatttacaacaaaggtcacacacatcaatactgagcatttttccttttgtacgtcagactctgtgctttagacctgcgtggatttttgttttttttttttgtttgtttctgttttgttttttcttttgcactgatatataccataccaacattgcaagatgcaagtgtggaaactggagtttaaataaaattacaggcaaaactaccccatcccagtgcggttgctgtacatatctacagtacaatttttggaatgtattgccatttaagaacatagaaactttctacagacaatttcacatacagaatacgtacaccttttagaaaaaaaggcaaatatttatcttacagagagcattgtattttacatttgcctgcacgtttcttttttctgtttcttttctttctttctttttttacatactagatttattaaagtgaccataagtgccgaagcggttttctaatggaaagcagactggattcacaacacagaagcagaattggtggaacaggctttcgggaactttcttcccctggtcacacggcagatcggtccccaaggacaggtgctcagccaggacttttgctttaagaaggatttgtctggagaaaggactagagagaaatccagctcagatgtattgctcattcctcttcagaaggactgggtgggaatggagcaggggctagaggaatctggaagctaattcttttaggctttttccaacagagggaagcagagggacttctgggtctggaagttggagcttacggaggcgacagtgcaggcagctggctgctgtcgggctcctggagggttgcaggggttgagcccagagtgagagccacaggtgcgggcgggagcagagaggagtggggttactacccaggatggccctgagattgccaagggtgaaaggcatcgtggagcgcaggcctggggggcaaggactcaccaaccaaaggcaaggtttggctctgaaacctcgaccagttggttcctcccccactgcccacacccaaggaccaggactagtctgtaccgaggaatggccaccccgcgcatttcaacagagcacgtagcaggcatctgtgccaagtcagccactgcctcctctgctgcttccctcaacaggcacaataacatcacaggcaaacaggaagcttggaagtgactgggagcagggcagaaggcccagaggagggcgtgcatggggcgagcgtctttctccaaatcatgaaggtgtacctgtgggctgggggctctgtgcgcagaggagcgggactagagtccggaggagggggttagagctgtgcccagtgacatatacccaggctggtggcattggttctgtccctctgggcacggcatcaatgtggaggcagccctttggtgagattctatttgtgcatttacccccatcatttagaaatagtctccagtgactcctggcccctgtggcttctctgcctgagcctgacgggcccggtgactgccgggcctctgccctgccggctgcactgttcattgctaggctgcccagggaggaaaccttgggtgggtaggctgtttgagtacagggagaaaaatgcccaggagagctggaaggcagggtggggtggagtggtgtggggccccccaccaatgtcaggggctagtccaccagagcccccggtctgctgctttgtaggtctggggcaggaagagcttgcccaggcagatttctaacctgggctgaagcaatgccctttatgcagctcccagacctcagcccttgaagtctccaatccgtgggcagtcccatgggttagggctgaaaggcaaggatgagaaaagccctggcctcctgggacttggaggagtcactttctgtcaggccactgtccagcaatatggacagtgtggtccaggctgggcttgctgcttctcttggggaggatgagagccctagtctctgagggaagcagccaggagctgctggctaaccctgattccccagaaccctggagcacagtggactcccagggagccctgccttctgtctcatttttgtcttagctctgaggcaaaggagaatgagtgaacaaggtggtctggctgcaggctggactgtggctggtttgtctgtctagtagggaccaagcagggaaaggccacgaattggaagaggcaagtacagccccgcacagggaactcacagaagggtcttaaccctccccacctactgtgtcctgtacccaagcagcttcaatagctcaagagccctggggcaggcacttgattcacacagcctggctgaggactggggattagccagagaggtccctgctctgtatagggtggcatcaaacccagccttcacgggcctcaaccgtagtccctgtgctgccctcccttgtagaaagtaaagaaaatcagttctgaaacactgggaaaaagctcacctctcccagttggggcgaacacgctagagttcaagttccatagttcaatttgggatttaaatttctggtcctattatttttcttacaaagtagagttttgccccaggaaatgcagggcagcttcttgaaagtagagatgtgggtaaggaagaggcactggctcacactgattgctttggagaattccaacgagttaggacaattcaaaaatcctctaggtcaaaagaatctgtggtggctgggtgaagtatcaaacaccatcctctctctttttaaaaaagaggtgtaagacagcaaacaggtccaggccgtatccaccagccacagttgtgggtatttccttggggtagtggagacaggggcagggacggggggaaacggtcctgtggcaaagtggtcctgaaacagttccccgcaaacctctgctgtggagaactggaaaaacccagccatgaggggaacaggctcccttgtaccccagggaccaagatgaaacaaaacccaaaacccagtctcaggaacggccgctagggctcgggccctgccacttctgcctttgtgggtggtttggtggttttagaacagaggaggcaacaggagagtgaggcctcggtcaggggcttgggagccagggacggacagtcagggctccttccccagcccagggggccagggtggggtgcagaagggaggtgtctggagtgggggtgcgtgggtggggtggcctgcccacctgtggagtgccaggatgggcccatgactcagactaccagagtatccaggagcccttggggagccagccctcctccttctacctgcacctattattttgtgttgaaatcctaggaaaagtatcattttattttcttgcaaaaaaaaaaaaaaaaaaaaaaaaggaaaagattagtttttctgggcctgcctgctggggcctgggtgggggtcacctgcctgtgtttgtgcccctctgcctggggacactggcctttctgctggcagagaggggtggctacgagctgggcaggggggtgaagtggcaataaacaggaaccttgatcgcatctgtacacaggagtgcttccttttacatttaattctatattgtttgaagtttccttttcctttctccctcagtgtacccctttccctctgccagcctctggggtgggtggctgccaaccacagcggggagggtcaggaggcttcaccatcagcctttccccaaaaccataaactattcacagcctcagactcctcgtgggttgttgttttttttttaaatgtatgtatgtgatttgttttgtttctttttaagcaacaaaaggtgtagaaaaaggcacaggtaactgcatacatgggaaggtacaacagatggggccgtgagagctcctggacggagggacagatggggctgaggaagtgggatgattcgaggaaagtggctggaaacgtctgttgctggacactggaagccagatgctgaagcagttggagagaggctaagcgttggggggaaccctgtcctcaggctgatgtggatgtgccctgggctccccacttcctgagggcttgggggagtcctgcctggtcctgggttccccggagaggttcctcgtccgggctgggaagcgggcagaggcctctgccaggcagcccacagagctgctgcggtccagcggcggggtggcagaaggctcggggttggtcggtgcacgcggggactccaagcgggggctccaggactgcgctgcccggcgtccctggggcggccggggcaaggtgtcgggtggggtgcaggggctgtgcgtgggtgtgggctctgcaggtgccccggtcccatggggtgtccagtcaggaggcctgcccgggcctccgccggtcctctccctctccttggggtagtccccgccctccagctctgaggagagtgtgaatttggagaccttagccacaggcgacacggaggctgacgagctctcagtgggactccagcggcctcgctcctgggcctcccgggcccctgtcaggtcgctgccacccccggagaagccactgacccaggctgcggtgggccctggcagcagggtggggtgggctcctggccgggcctgcaccatctggatcccaccgatgggaatcaagggacatggggcacgggtcaagtgctgggagtgcagaggcaggtggctgaagatgttctcctctgtccgggccaggatgtggccgtggaagtcatggagggcggagaagggtcgggaggagagaggatgagcagggccgggtgagcaggagggacttcgggactcggccttctgctggggtcagaaaacaagacaaggtaaggtgaaggttacatgctgggcacatggggagccgaggcctggaagtgggagggggactcgcccaagatcacagagcgagtccagggtcccggctgagctgagcccagaaccaagttcctgactccctgcccacagatgctgagccagctgccatctctggaatgggccatctccagctcgacagtgaccatgagtatgctcaggccccatggtctccatgcctctagccagcatatctgtcttcaaaggaggggatacttgagcgacgtggggccctgttgtcacccatgagcctggcctctatgtgggtctgctgcctgtcctgttcctaaaatggtcttcacccagcttcactcttggacatgagttcccacctgaggctctttgcccttctgctacctccaggaatttgaatgtgaacccaaaattaaaaatcaaggaaagattcctagatcagtgttcctccaggagtgacagggctgggtcatggcaacacggggacagagaaggtgtcggaagggggtcagctgacaatgatggtgctatcggtggaggggtcatggcagctgaggggacagggatggtgactgtgctcatggggtggcagcagtggtgtgttggtgcaatggtgacagtggtggtgctggccatggggatagtgctgatggttgacaaggatgatattggttgtggtgtctctgagagcactggtgacagtgatattggagatggtgatggttttggttaagttgtgccatctgctcaaagaacacaggcagatggggatggggtgggggatggggaattgcacgagtatttacaacctcatccaaggccacaccccttgcaagtgatatgatatcgtttggatatttgtccccgcccaaatctcgtgttgaattgtaaaccccagtgttagaggtgggcctggtgggaggtgtttgggtcatggggacggatccctcagggcctgatactgtcctccagatagtgatttctcatgagatctggcattttgagcgtgtggcacctttcccccaactctctctcttgcttccactctgccatgtgagatgcctgttcccgctttgccttctgccatgagtaaaagctgcttgaggcctccccagaagccgagcagatgctggcaccacgcttcctgtacagcctgaagaactgtgagcctattcaacctcttttcattataaattacccagtctcaggaatttgtttatagcaatacaagaacggactaatacgtggtagaacccatttcccatgaactccagagtccatgctctgtgcttctgaggctaaaataaagtttaataagccagctgatttagggcagccagcatggtgcatggcacagtaggtgcctaataaatgtttgcgaaattattaataactactgagctggcagagctgtttagttccaggtgtgatacccaggagggtgtgaacttgcaacccctgcacccacaggggagaagcggcccagccaccaggggcaggaactcacccacggggaggcgcaggtctctgggcttctgctgaggagcttgtgaggtagaggcgcgggcgggaagagaacccgtgggtccagccccaagcctgggccatgctcccccgctgaggggctgcccggcccagccaaggcccacttccctggcggcgctgaccgtggtggtgactcggcctgacctggagaccatctcctggtgggcgagtatctggggaggcctgggtcggtggtaccctcgagtttggagagcacatgtgctcgaggggccagttctcttcccagggggcagagggtgagaggagacagctgaagtcttggagacccacaagggagagcgcccatgccccttcctgggtccacgtgcaggccaggtgggcttggggctgaggcctgtggttctcgggccggggagcatcgctggggagatgagtcgtttttggttagcgagtgtttgcgggctagtggtggacggctgcctgcttctttgcttggggaccacggtcttcttggggacacaggcttgtagctcaaggctgagcctgtgtctttctccacagagcccagaggggccggtcccagccaggggaggcccggcatgctctggctggacatggagcagctgctggctgtcaggcgctcagcttccgagaccgagctgcctcgtgtagcctccgtgccagaggcgggggcatctgggggctgagggcccaggatgggtgaggagtctgcccgcagtgcatgtggtgggccaggcgggggcgcctctgaggatggtctggacagctcatcctggctctcctcctcatcctcatcctcgtcttcgtccaggtctgagtctgagtccgagtcctccaggtccgaaaactggtgctcctccacagcctctgaaccctctcgtccttccgagtcctggaacaggtcgtcactggttcctgagggcaaacacagaagacccaaggtcacagttgggccttggccccactgcccacacggctgctcctctctgagccccagtttccttgcctgctgactgggcaaaatagccatcgcaagggcacaagattgttgggacaaccaagaaacgtaacagatatgggagcgctttgtaaataataatgaacaataattcccttatgcctagaatgtgcaatgttcagttctgagagctttaggtatatttattcatttagacctcagagaatcctgtgaagctggtactgttctcatcctcatgttacagatgaggaaactgaggtaagagaaagtaagtaacttgcccatggaagacagcagtagggctgggattgagccatagcaaagaagacagtctttgtttgtttgtttgtttgtttgtttgtttcactagcatctcagtgctggcttcaccatgggcaacttaccaccttgctctgcttggtctccccctttgtcgaatgaatgtgatggtctcacctcaccaggttttctaggaggactaaaatgaaggcctggcacatattgagggcttaaaaataattatagctaccatattaatacattaatgatgaaatctgttattccaggacagggcagtcacactggctggtccagcagcacagagccatccgtggtcagtgtacacacacatctgccacggtgaccaggctcccggtggctggcacaatggcatctggcaggtggcggactctggcctctgtgggcggcttgactaagctggcctcaggctgcagagcaggtccccatcccagccacgctcttatctgaggagccactgcccttttgaagtccaggctgcctctagcctcggggccctcccattgcctgccagccccagctccaccccatagttttcgacctacatgtggctgaatgcccacttttgtccactttggacatctgactgctgcatgttgagtgacttggaagcaattgttcacaagagtaaacaaaaaacaaaattgtgatacttgtttcagatattgttggacatttaggtcacttgcactccttaaacagactataagaataatgacagagttattgaatagagtctaaaagtgggggttagggctctggaatactagcctcctggtctgattcctctgggatgaccccaaccagtcgggtcacctctaacatgtcaggagtctagtttgggcatctctgaaatggacagcaatccggatgctggggagagctccgctaacatctggcctgttcgctggcccatcactagaccattggaacctgtttctggtctgcagagtgaggttgctgacaggtgggttgagctggccagccagccccatcgctcacacatatcagtactgcacccacctgaccaggagggctggcacagaaactgactcaggccgctggggcagctaggctttggctctcaaccatgcccagctgccccggggccagaaagcccggaactagcacttccaagtcactcaatatgcagcagtcagatgtccaaagtggacaaaagtgggcattcagccggatgtaggtcaaaagctatggggtggagctggggctggcaggcaaaaggaggcccctgaggctagaggcagggtgatgagaccagaggaggaatgaaggattaggatgagagcagggctggggatgggggtgaactttgtagttatgccccaggcatttacctcccttgcctaggactttgggaggggcctaattcaacacctgttcacctggccctgcccctcatttacatacagcaaaatccaggcacagatgacccagtgagagctggtggctgagtcagaactaaggtttacagcccttgcattattacgctgacagtttaaaaatgatgtgctgcactaagaagcagggaatggtcgggtttgaatctcagcactaccacttccttgctgtgtgacgttggatactttactttctgtgtgtctggtttcctcatctgtaaactgggtagcaataaaagcactctaggaagctgttcagaggactgtgagggtctggcacacagtaagtacccaataaacttcagctcctgtcatcccatgataccctgtccccccagtctcagcaggcaggtagctggggtgggattgtcagcattttgcagatgaaggtcacaggggtagtgttaggagtgaaggagagtcaggaccagcgtctcctgatgtccagcagggagggctcctaaagatcctctttactaatgtggaagttgagacccagtgggggtaatggcccgtcctgggcactcagtgcatgaatgctggaagccaagagtcccctgcccagctcggggctggccggggcctccacatctgcgttcctgcagggcgctgagggaatgcccctggctgggcggccccgcccctgctgggatccaggccaacgctccacaaatgagagagcttgagcgcgcggcgggcgccgctgggagaggccacacggtggcgctagcgcccagcctggccagcaccatgggcagggccggggcgcctggctccttccaggcagttctcccacgcgccacctcgcgtcccacagacacgaactcctgccgctccccccggcatctgtctcgtcgcgggaagtggaaactccatccttcagtctcttgggccgtaatccttggagtcctccatggctccttttcgttcttccccctctcttctgccccatatggggtcatctgagcctgtgggctctccctccggaacctccccagaatcccgccgcttttccacctcctgagcacacccgtgctccccgcgcccacggcacaggccagaggacgccctgcctctctcctccgctccagggcacccccccatgcccttcagccctcaggctctagctctctctgaaccggctgcccccgcgtccagcgggctccagcacgcgggccaagcgccgtggcccccggggaccccacacctgctgctccctctgcaggagagctcctccctgaccccacgtggctcctgaccccggttcctccgggtgggttctctgctcacaccgccctgtctagcacagcggccctccccacgggccccagccctcacttggctcttctgctttctctttggcttcacaggcagggcccctgctctactccaccatcgttccttgcccagctcccctgccatgccgactgcctgagggcaggagctgttttatttattgcggaacccccagcacccagaacagagccaggcacagagactgtgcccagtaattacttctggaatgaatgcatggatttcgtcctccgaaaagtggctctgagcatcctcgtttgctccactgggaaaatgaggctggggcagggcagggacctcaggggagggctctggcttaggttcaggctcccctggtccagcccaccaggcagtggactggcatgcagccagggtttttgtgtgaccttgggctatttttacctgtctgagctttgacttccctgacttaacatgagtgacacaagtttctgccacctgttttgaggactcaatgagacaacatgtgcatatggcccagtgtatccttgacaagcatagtgaaccccattctagctttgggggggaacagccccaagttcactgtgttctcctctataaaaatgacttattccacctaaaaggaaatatgacttaactcttttttgtaagaccacaaatacatccccaaattggaaaaacaaaaacagaacaagacacacagtgcgtgcatacacactcctctctgtcacactctaagtcctggggctgatttcagggaatcagtatgcttcctgctttgcttggtgctggcgagatggctccagcctccttctgttggagggactgccgtccaccaccaaagcccctctggccacctgcctgactgctgaggctgggcagtgctcagccagacccactggcttcgactcctctgccctgtcttctcagagactgactctaagatgcctcctggggattgaccaccatggccggggtgtgtacggggatggggctgggaggtgacaagcggctgtcaggtctggtttgggcttttttgaaactctcctagctccaaaaggcccatgtgtcaggcccatgccagagtgtgtaggcaggagtgtgggtgtggagcttcggagagtatgtgtcccacagtgtcactatgaggggttggctgggataattcagggcatgcatttagaacccgcctgacacatagtgggcactcaatcaacgttggctgtaagttctcttgtgtgcatttattcagtaaacattcactgagcacccatgggtgccaggcgctccacctgcatggcagatggtaatgcatgatagctagggctgcagagcatatcctatcagcatgtggggaggtggctcgatcattcagggaatttaacctttgtctgatacttgggagaactgaaggtgaagctattggagggagagaggggaggagggggaatggggcaaagcagacagaaaggaagcagggaaggcaagcaggaaaggtggaggaggatagggaaagcggacaaggggaaaggggacggagaaggttggcaattgttaccttcttcggcttccagctcctccagcacccctgtctcttggcactttttgctgtgggccttcgacttcatgtgcttagtcagattccctagaaagaaacgagaatacttaggctctgctatggggcaggaggccagggcggacccagggctcatggaggtagcacctggccggcaggccatggtttctcaggccagtcaaggccctgccagctgcagggctgggcaggagctggggtatccctctgccccggtgctcaggcccagaagtgtagccacagctgctgttcagggcagtgcacagcagctaggtggggtgggcgagggctgtgaggggacagacagtataatgaggaagtgagatgctggttaaaaaacaaacaaaaaagaaattaaaagacaactcaagtgcaataggtttttttttttttttttgcttctgatttaagtctggccctagtagctggtgacactcatcaggcaggactattggccatctcaagtgtgggatgacgtgggaggctcccattgaccggcatgacgggtgaggactgagcatgcccttctggctgaggacacctctagggcagctcacagggcagaattctaaagtgtaggtagagaaaccagggcaaatttaatattaggcatggcgagagggcagaaggtgagagtagggaagtctactagccagggactcaggagccacaaggctgggggcccaagcttggtttccatagagaagtcccatttctgggccttcagtttccccaggccaatctacagtgcagacacaggaccagggtggttcagggaaggcctgggcaaggcctctgtcctgctccatgcctacaaagccctcagaggggaggctgactttgccccaagttgtaggtccagcccacaagctgaagagtggaggcagcagctctgtggaatcagggaacagtagcaacagcttcagttccccaacaggtgcacaacatttcacaggccacacagctctgtggacaggagcgttctaggaaggacaggcagagcatcccagcctgccccagaagaacacaggccagatgcctcaggatattcctttgggcccagcagctactcccaaaccgtgatgtgctcactgttgccctggggatggctatatttccatatggtcattaacatcataagtcataagttccctgagtcaggtgctctgtcccattagtctaatgaattggtaagtttgaatggatggatggaggagagaagaatggaaagagctaagcctcctggagtggatgaatagagcgattggtgcgtggatagataaagtggataaaggaaatataaagagaatgaagaacaggaagaggatagacagaaggatggaacgctagatgagcagataaggagatgaataggcagacggaggataggtgagtagatgaaaacaaatggaaggatagatggagaatgggtcaataaacagatgagatgatggagagctggatgggaggacagagacgtggatgaatggaagaatggaagaatggctggttggatggatgaatggatacatgcactattacatgcatgagagtacagacagaaggatgaaagaatgggaagttggatgggtgggaggacaaatgggagaatggtaggaacagataggatgagcagataaatgaacaggaaaacaattagatgagatggatggataggtgaccagggagagggcccatggatgaactgaagggtgcttcttaatcattcctagaattagaagaaatatttagggttttgctaagaggttaatgggggacccttaagctgggattccctgaggtgtccaagtcaagggcagcagggatgggaggggagctgtttcctttcctctttcttcaccttggtcctagttcatgactctatccttcccaatttgggttttcctcctacaaccggaaataaatctggatgtcctactcctggccatagtgggagcaaagccataaatttcagagtcatcttgtagccagagggtcctcagaggtccctatccaaccttgtggacttcggccctcattgtcatgagaaggcaaagccagagtaggacagtcaagaggtgggaaaaggcagctggggtcttccgcggatcagagatacccactgtcctaaggtcgtggagccaggcccaccctaccctgactaccccaggccacagggcactgtggacactgctcattctggctattacctcacttgttgcacctgttctgcctggaaggtttaggtctctaatgaaccaagctagacgctgggcacacaatgggtgtacaatagccatgtatgggaaatgcccttgtcatcgcaggaggaaaatgttggaaggagcttcaaagtccatgtaattcaacccccgccaggctgaggttctccctgcttctgatctgactctgggcccaggtgctgatggcaccattagacaagatcactggctgtcttggatgctggcagggctgcttgaaccaacacagtgaatcaagtggtccacagtcacagtgctggttggtgccgagttccatctagacccaggtctcaagactcggggggcctttcccactccatgtggaggcagaatggaacctagatggaacctggcagccttgggtttgactgtgggctctgccacttgccagctgtgggctcttgggcaagttcctcaaccttctgagccctggtttctgcaaccgtgaagtaatacctacctcgtggggatgcgggaggacttgatgaggtgacacaagtagagtggcagcagagtgtgcctggcagagaacagacccctgtccccatgtgagtcactctattgagcagcccaggggctctgccacgcaccatgctgggtgtggaggaagagatgctaagatgatgcttttggtgaaatggttttacctttctcaggagaaggcaccagggagccccccataggcctccctctcctctgcccccgccacgggggtgcagggaggagtcaggatcggaggtgactttgcgggtccaggagtggacactggatgggcagccctgagtgctgtccgggtccctctgtgacttcccctctccaggcctgtctcctcctctgtgaaaggggaaggtggggcacacggctgcaggcacagcctgaacaccacttccctgttgagggccagggcctcagcttgtcaggcagagccacagcttctcacagtcatcccagaccccaccaaagcctgacaggcctggaatgaagaggaaaggcaagtgagaggtaaagtgatgggtgtcgggaagaggcggaacctccgataaaagggcatccaccaacaaccctgcctgcctcatttggctttgatcaaccgctctgtccctgcccctgccgctggcagacctgaggccatctctgtcccctgaggcgatcggtgcaagggcctggacatggcacagccatccgctggcctctgggaaccatctgagaagaggaaatgggacccccagccaccacagggccacccacaggcctccccagccccacctactgacgcattccttagccagtttccagaggcctgagctgctgccacgacgtctgacacaagagacgagacacacacggcagacagagacagacaggaaggcaggaggggctccccaggccctggtgtagccgggtggtagggtcgggagggctgcctggggcaggcctggaggtggcccaatggggaggcacacagccccggagacaaggggcctgtgttgtctgagctgatggctgacggggcccagcactccacaaagacacctggccccagaaacagacaggagctccagcgccctgctctcccttcacccccatactgcagagagagttaacagggagacttccctgcttccattgccaccatcccaacctggccttccctctattagtcaaacagtttcagattccaccatttcccatctgctcccttcgttggttctggaaggttctagtcttctagaagcccctgtgaacagttgaggaagagctcagggcactgcttgatcactggttgagagcacggcctcacagccctggccttcaggacagcaggggcagccttacctcgggggatgctctacacccctggaaatggggagggcctacagcccctctgttcagattacgccctctggaccctccaaagccctccagggccctggctctgtgctggctcagagagacccaggaagggactgcagacaggctcagtgtggcttccaatgaaggcatctcctagaaagtacgggctcctgctagggacccaaggcaaagggaattgagtgggccccctgtgggaaactgcttgggctggaaacttccagtctcacgcggcagagtgatggtttcctgaggcgatgggcagcccaggctgcgtgtggggcacaggtgtgctctgcatggccctgggctggcagtgtggtcccctggacacaggccactccaagtgcagctttttgccacccactccagggaagggagggaactaactgctcacagaaaggaagatgatggggtgatgccctggagctcggggcccgtgttctagttacagctccagcattaacagttattctgttttctgggatcactttcttcaccttcaaggggacttgggtgataagttttccacttttagagttgacgaccgtccattgaattgtcagtcagttatccccgtcttgctcttccataaaatctcgactggctgcagaaggccagaggaagtgcggttggagggcgtgtcagggacagcccatgtccagggcgacgcatgctgggcagggctgcagggatggaagacaccttcgaagcacccatggggtgggtggggagtcctgggccaatgtgccctctctgggcaacctttgggacattgtttatgagacaccaagagagaagaggatgggggaaaggcagtgggagggcaggcacctctgtttaaaccaaaaccttgacaggaaaatttgagctcaacttgcagatgatggcgaggggacagaggagggcaggggttcagttaatggggtgaggagaccagaaatgggaacacagtcagagaagaggccactctcccaggggatgtgataaactggcccctgacctggtatagagagaacggaaggggccaagcagcaagagcacggaggaagtgaagaagggtagggaccctgctgggccccctccagagcagctgcccagcctcgcttgctgggagcaactttgccaacagaagaaaggtcaacaggtggcacagctgaaggatgcccttgagtttcaccccctgagaaaccgtggggctcccagaagcccccaacttgctcaaaggagaagacaggaccctgatgtccaaaccctgacccaggaatctatcaagctccagaggctgaagacactggggtgccgagagccctgggtctccctccaaggcgcttcagtctgcagtgagcaagctgccaggaccttccctgcctatcctgcagtaggagagtgcaatccaagaatctcatggactcagctcctttgtccacaccaggggcctggcctgggtggctgtggcaggccaggccatgcccatcacccatcacagctctctgggatgcatgcctttcacagcaggcccctcctttcaccagtgactgccagagcctatcctgaccctgatgtggggtgtggctggggcaggggtgacagggctgtcagtctgggagtggggggctggccctgtgctgagaggtgcagagaagctgggtggagcaggggcatggtgggagtggagaggtgggtggaggtcggcgcgctctggcaggagaagagagcatgcgagtgtgttaagcagctgggagtggaatggatttccaaatgcaagagtggcagtgacgagcatggatgctggagtgtctcagatcagtggataaacggctcaggagacatgcagaagggaggggagatgagagaagatgcaaaaccatgaacggtgagcaagagtgccgcaccaggctgggcaggccagggccgggtggccacaggtgcaggggctgtgtgtgtgttccaggaggatggctgggggcagccatggggagccacaggccagtctggagccagctgctctgccactgggcaccaagctgggtgggaacccaggaaatggggctgctccaggccccctgcaaagaggtctgggcacctgaactctgtgctgggactcccagaggggagctccctgcagcgggcaggggcagtgccccagctgactctctcttacctttggttttaaaagcaaagtgacagtgcttgcacacatagggccggacgtcagtgtgggtgcggatgtgtttcttcagcatgctgggcttcttgcagcgaattccacactcctcacaaacatatttccctcggccgcggcctcgcacatatacatactcttcgtttgatttgtacctatgagcaacaggcgtcatagtaaagggaaaaaaaaggagaagaggcaggttcccacctcagaagacgcacgcgcttcctagattcatccagcccgttacagacgcaaggaatggaggccacggaaccagagaggaccacgagagtgggaggaactgagtcaccctggtgatccactgcggacccctgcgcccctccccctcagacggggggttgcactattcttcctcctccagagcagcagacactggcgcttcccactgaggggatgtggagctgcagggtgccagacagcctccttggcacagccagcccagctacagcttcgcccacaaagaacagccaccgcaggccaccagagtcccagagagggaatgatgataataaaacagcagcagcagctcgggcagccgccattcaccaagtgctcactctgccaggcactttacccaaatcaaagcacaaccacctcaccatggagagcctgtgagaccccgagatttagagacagtgagagacttgtccaagatcccatagccagaaggggccagaatcaggctttgaacctgcctgccccaaagcctgtccagtctgccaggaagccgccttgatattcatgggaggagaaggaacagggaccaccattgcttccctggcttcagagtttggaatgaggagtcctgagctctccccctcacctgcacgtcagcctgcaagctctgcaggatgcagggtcccagccacctgccacatcgcttggggttctatctggaagtgccaccagctttcagaagctgcgcctgaagcacgaatcagaatgctcttatttccacttagaaggaaacccacgagtcccacatgcgcaacaggatcacgatgaagctgtcttgttggtctaatgctatacatgtgcaagtctcagatgcggtggggagggtggcagggggcgcgccaggagaggggaccctggcataattccaggagaagagccttctgactcctgaagcctgagaggccactggcacggcacgtggaggaggcgtggcttctcaacctgtggggcgcaccttccaacgccagccagagttgccctcacatactcacgccgcaccacctgcccctgcctggttccagcacagaggggcaggaggtggctgggaggaggtgagcaagggacagcgtgtcggggcgggggggctccaccctgctccaatggggccatcagcttacagctgaaaggacttgggaaggaagggcttggaagaggggacttgagggagagagcccgctggcagcaacagaaccaccaccaccacacccccaccctcacactcgccctcacacatgctcacacccacacactcaccctcacacgctcaccctcacacacactcaccctcacacgctcaccctcatactaaaacatgctcacaccccacactcaccctcacactcaccctcacacgctcgccctcacactcacacatgcccacacccccacactcaccctcacactcaccctcatacgctcaccctcacacacatgctcacacccccacactcaccttcacactcaccttcacactccacacccctgccgtcacacttgccctcacacatgcttacacccccacactcaccctcaccctcacacaccctcacacatacacccccacactcacacccttacacctgctcccacccccaccttcaccctcacacacaccctcacacccccacactcacactccccctcatacctgctcgcacccccacactcaccctcacgcacactcaccctcacacacaccctcacacactcaccctaaaacgtgctcacatccccacactcaccctcacactcaccctaacacacaccctcacacgctcaccctcacacatacacccccccacactccctcacacccgttcacacactcaccctaacacgctcacacacagcctcacaagctcactctcacactaaaacatgctcatatctccacacacaccctcacatgctcaccctcacacatgctcacaccccactcatcctcacactcaccttcacactccacacccctgcactcacactcgcttacacccccacactcaccccccaccctcacacaccctcttcctcacacacaccctcacatgctcatcctcacacacacccacacacccacactcaccctcacacaccctcttcctcacacacaccctcacacaccctcacatgctcatcctctcacacacccacacacccactcaccttcactcccactcccacacatgctcaccctcacacactcaccctcacacactcacctcacacacacacaccctcacatgctcaccctcacacaccctcacatacaccctcacaccctcacacttcacacccctgcactcacacacacatcccaccttcacactcaccttcacactccacacccctgcactcacactcgcactcacactccacaccctgccctcacactcaccttcactcacactccacaccccaccctcaccctcacacccctgtcctcacactcaccttcatactcacacaccaccctcacacacactcacacacccccgccctcacatgctcaccctcacgtatacacccccacaccctcacactctttcacactccacactcaagcactcacactcattcgcatactctactccccaccctcacactcgcactccacatccccaccctcacacacccgttctcacacattcacacatcccaccctcatgctcaccctcacacacccccaccctcacatgctcaccctcacacatgcaccctacaccctcgcattcaccttcacactccacactcctgcactcacactcgttctcacactctacaccctaccctcccactcaacttcacattcacaatccacttccccaccctcaccctcacacccctgtcgtcacacattcacactcacaccccaccctcatgctcaccctcacacacacacccctgccctcacatggtcaccctcacacatgcaccccacacccttgcattcaccttcacactccacactcccgcactcacactccacaccccgccctcacactcaccttcacattcacactccacacccccctcacttaccttcacactcatacccttgccctcacaccttcacactcacaccccaccctcacacccttaccctcaccttcatactccacacccctacactcacacttgccctcacactccacatccccaccctcaccttcacacacccctgccctcacaccttcacactccaccctcacaccctcacacactcaccctcacacccctccaccctcacacaccctcacatacacccccacactcaccctcacactcaccttcacactccacacccccacactcacactcgccctcacactccacaccccgcccttacactcaccttcacacagtccacacgcccaccctcaccttcacacacccttgccctcacaccctcagactcacatcccaccctcacacacaccccaccctcaccttcacacactccacacccccaccctcactcaccttcacactcacacccctgccctcacattcaccctgactcacaccccaccctcacacaccccaccctcacacaccccaccctcacacaccccaccctcacacaccctcacactcacaccccaccctcacactcaccttcacacactccacacccccatcctcaccttcacactcacacccctgccctcacgttcaccctcagactcacagcccaccctcacactcatcctcacacaccctcacatactccatcctcacactcaccttcacacactccacacccccaccctcacactcaccttcacactccacaccttgccttcacactttcacacacccctgcccttacactcaccttcacacactccacacttccaccctcacaccttcactccacaccccgccctcacaccttcgcacacccccgccctcacactcaccttcatgctcacattccacacccccaccctcacactcaccttcacacttcacatccctgccctcacactcacaccactgacctcacactctccctcacacatgctcacacccccaccctcaccctcacactcacacacatcctcaccccacaccctcacacatgctcacacccccacacgccctcacacaactcaccctcacacacaccctcaccctcacacatgctcacaccccaccctcacactcacatgcttacacccatacactcacaccctcaccctcacacatgctcacacccccactcacacttaccttcacactcacacatgctcacaccccccactgacacaccctcaccatcacacatgctcacacctccccacaccctcacattcacacatgctgacacccccacactcacacgctcaccctcacatgctcaccctccacacacatgctcataccccacaccctcacacacaccctcacacatgctcacaccccacaccctcacactccccccaaactcacaccccatactcacatactccacaccccatcctcacacttatgctgacacccctaccctcacacacccgactctcctccccccacaccccaccctcacacatacgtccccaccttcatacacatacatacactcacatcactcaccccacaccccccacaccctcacacaccccacactcacgcccctacacactcccacaaccacacttgcatctccacttgaatactcatataccccatatttacacatacacacgccaccctcacaaccatccacacacacccccagactcacttccacatccccacacactcatacatacacataaccccacaatcacacaccccacacacccccacattcacagtcacccccacagtcacacttacatcctcacactcccactgatgcatactcccacaatcaaacccacacaccaacaccccccaccacacggacatgcaccccccaccctaacacgctcacagtcacacacgctcacacccatgcacacacaccacacacttagactcatttgcacactcagaccacactcacgctcatacactctcctggcacactcaccctcacctcacacatggactgctgtccaccagtacaggtggaccctgtttttttgtcacctcagatttggccaactgatgccgccaaggagtctaaaactgccccttctccaccatggctgccctgaccagccagttttggccgtgtccccagtgggggtcacctttccacgggatccaggacacgcgccaccttgcgtccgagaggacgaactgaaggccgtggcggcggtacgcagaaatgactcggttctcttaggaagggcactctgtggccaagcacgaggcatctgcctcgatgtgacagcggctcaccctcacgtagcagatctccaagaccaaaaccagttgctcacacctggatcttaattcccatgtccctccatgcccctgggacctggtggccagggaagatggctgagatggggccccctttcccagctagaagaagacagagtgaggacagcttggtctcccctttgcactggaagccccgcaacctcctggacactagccttcacctggccttgcttgtcgggtccatggcacttgctcccctcccgccaccacctgcaatggtgtccttcagcctaatggtgtccttcagcctagccttcaccctgctgatccccacacaggcccacagccactctgacgtctactgggcctgtgtgccagccaacctagaagcaggtgccagggtccatctgccccagctgctctccgaccccttcatttcctcctccacatcaagcttaaatggtacatggtctttccaaatggagagagagagataggaaggggagggagagagaggactctgagccttcaaggttggtgccttgacttggggcggggtgtacacaaccacgtgcagcaccttgtcacatcagggagggagtgtagcctgctggggaacacgagggaggagcctgggttgggtgaggccagggatgacaggagagatggaggacaggagagatggagaatgggagagaagggaggacaggagcgaagggaggacaggagagatggaggatgggagagaagggaggacaggagcaaagggaggacaggagagatggaggacaggagagaagggaggacaggagcgaagggaggacaggagagatggaggactggagagatagaggacaggagagaagggagaacaggagagatggaggacaggggagatggaggacaggagagatggaggacaggggagatggaggacaggagagatggaggacaggggagattgaggacatgagacatagaggacaggggagatggaggacaggagagatggaagacaggggcgatagaggacaggggagatggaggacaggagagatggaggacaggggagatggaagacaggggagatggaggacatgagagatagaggacaggggagatggaggacaggagagatggaagacaggggcgatagaggacaggagagatggaggacaggggagatggaggacaggagagatggaagacaggggagatggaggacaggagagatggaggacaggggagatggaggacaggagagatggaagacgggagatggaggacaggagagatggaggacaggggagacggaggacatgagagatagaggacaggggagatggaggacaggagagatggaagacaggggcgatagaggacaggagagatggaggacaggggagatggaggacaggagagatggaagacaggggagacggaggacaggagagatggaggacaggggagatggaggacaggagagatggaagacgggagatggaggacaggagagatggaggacaggggagatggaggacaggggagatggaggacatgagaggtagaggacaggggagatggaggacaggagaaatggaagacaggggcgatagaggacaggagagatggaggacaggggagatggaggacaggagagatggaagacaggggagatagaggacaggagagatggaggacaggggagatggaggacaggagagatggaagacgggagagagaggacaggagagatggaggacaggggagatggaggcaggagagatggaagacatgagagatagaggacaggggagatggaggacaagagagatgaaggacggggagatggaggacaggagagatggaggacaggggagatggaggacaggagagaagggaggacaggggagatagaggacaggagagatggagcacaggagagaagggaggacagaagagatggaggacaggagagaagggaggacttgggtaggcaccccccggagcaacggcagagtgttgagagcctggagtatttggttgcagagaggagatgaggctggaggaaaggcaggctggatcaccattggccttgaacaccatgctaagtttgggattgataaaagccttaaagagaaatataaagtctctaagagaggatattccctggccatgggaatggcctggaggaggagagaatgaatccaggcccaggctcatgttctagaacagcgatttgagatgccttctgggcataggctccacaggcctcagtggccatttggatggggcaggggtcagaacgaaggagaaaccaagatccagaagtttcaacttggctctagtggcaccacccccgagcttggggggaagtgatggaggactctagtctttaagcattgagtatgagatgcccatgaggaagacatgaagaaacgtccttgtgtcagaaatcagtgggactgagaaggggatatgtagatttgggaggaggatgaccccacaagacagaagagggtagtgccgacggcagagacctgggtggcacccaaattcaagggtgggcagaacaaatggcaccccaaaccctgccctcaaaaagagaaaggtcagagaagcaggaaactgggagagaactgtggcttagccaagaggagagggtttagaggaggaggggcccatggctggacatcccagagagcttgaggaagacggctgctgaggacccaggacttgaaagagggcagtcctggttcaacgacctggaacctgtggctcctctgctcgttgaaggccaggaccgaggcttgtccagctttgaggttcccagagggtccagccagggacaggcctatggcagctgtctatcagtgtggacctccccaagcctgaggtagacctgccgggctctgggtccagctcctcctgcggtgccagagcccaccccacccactgtcctctcccacagcttcccagcagtgtcattgcctccctctcctagccccttccaccaccacagacacaagcccagctctcttcccatcacaaatcaaccagccccaagcctccctgggcccaaatcccgggccagctctgctgtccctctttcctgcacagcccggatctggagagggctgtccacacctcctccccactctatgcttttgagccgctgcagcccagctctgatgaccaactgttcttgccaaggtcacagcttgctccattgaaagtccatttgcctcatcctgtccgccctcttgctggccttctggaggcacctcattccctcctgcttgtgtctcctttgcaagctccttttttgcccaccctttcccatgccgacatggcccctgccagcctccgacctgcactcttctcaccacacaccttccccaggtgaccctccacctgggtgctgatggcccccagccacttctctctcgagttccgatgcctttgctatacatctaactgccttagtatcacctctggtggttttcaggcacctcataccttgcgtgcccagaaccagccttccaagtccctctacctgcagtgtctgctcctgggtccccgttctctctcagcaagcagcacctgcactcgtgtggctggccagcccacaggctgggcttcatccttgatggctccatttccttcatgctccataatcaatccaccaccacaaccatcaatgctacatgcaatgcatgctccaagggtgccacctctctgtccccaccagccctggccaccaccctctctcctataccactgcctcctttcttcacaaaacagccagtaggagctgtccccaaatccatccaggcttaccactccttccagcctagaggtcccacttcatgcttctcccactaccatcggagcgaagccctgcattccttggcaggaaaggcccagggcaccatctgcccttgccacctccccagctcatctccctccaattcccactgatccccccatttcctgctgcactccccctccagccatgccaaaggtcacctggagccttgcatccctgccccagcaccaccccctctcctgtaagaccagctcctccactctaccagaaatttgcaccaaggtcctgtccttcggaggcctgtcccacacccctcctctggacctggggatctcacccacttctgctccagggcacttgtcagactgtgtgtactgcaatggccttttcacaagcacagcccccatcatccctgcgcgggtgaggaccacatctacctcatttgtcaggacatccccagcaggtgcccaatacatattcattagctgcacatcagagagaccagcgaggccttctttcctggggcctgtgatcctcagattctagccttgactttcccactccaggagttcctgagcacaagtttaactcaatgctgggctcccaaaggaggcgggacacaggcagtgcctcagaaccttgatgggcgcatacgctgcccaccttctgagaggagtgactctgctcagagcgggagaggtgggcaggacacttgggtcttggttctgctcttgttggaactcgccaggtgaccttgggcaagtcactttctttccttcggaaatagtcctcataacctgagacacggcagagcacggtcacatggcgggcatcactcgatcctcccatcaaccattttaccatcgtccccattgtatagaaaagggaaccaaggcccagtgggttcattgacatggccaagaccacccagccagcaattttaccacgcagcaccctgttcccgcacatcatctaaacacttttagatgatgccgaccaaggttttgttagcatcttccctctcccagggacctgttacactgcagacaaataagaatggcatcactccccgcccagcccttccagccagcgctggggtggaaccccaggtgttgacagctgtagagaaatgccggggaagagccagggtgggaaaccggaacaccatgatgggggtccctggggatatagtcctgcttgcctggtctgctggcctcttccctcctccacccaaggcagccctttggaggcctacgccacaggctgccctttatcaggggagcaagtgaccaacttccctgcctgttctgaggctgcaagacggtccactgctggtgggtctggcagggctgacttatggagtaatttctcccagtgtctggaagcagctttctgcccatgcctggggtcagggcaggacagaggctatggggaggggtatggcgagaccagggtcttcatggatggatcttttcattcttatgctgtggctctaagactcatggactcaaaggaaaagaaaaagatccttaaacaaccccttgatcaggagggtcttacaatcttcactgaatacagaaggaagcagaaacagagaggttgagtgtcttgcccaaagtcacaaggcagctcaaaagtggtgacgcaaggactggaccccagatctgacttgtgtgccctgaagagcagcacagtatgatctagtgtgatgtcctctcctgcccccggcaacttctcctgcaatccccatggctggtgatactgagctgcctgtgaaccatcagcacatgatatcttgggttgtagcagacccacagcttctgctaagcacaaaggaactcggcacagagcccccaaaggacgtgacacgttcctctgctcaagatgtcaaagaggggttgtggtggaaattgcatggcatttcaggcaaggtgatggaggaggttgttgttcccggactctgaatataacaaaagatggaaagaagctgctctgccatgcagtgggctccccgtcactagcactgtccacctagagaccagatgaataggctatgaggtcttctagtagtaggtagtaggtagaatagcattattctactactcctagctagtgggagggaattcatgacgtctacgtgctcaggacacgtccagcacaccgacagagcggctttgggtggattagcttgtgtatgagtgtcataacattgtaaagtggatatatttagttcacttggatatatttagtttagcatatttgttccagtaaatataagtggctatatttactcctaagaccaagtggaggctcagggcactagagggggatgggctggcaacatgatcaagcaaagcaggggaggcgtaggaggggacgcggtggggactgtggtgacctgggaggcagggcatatccctctctgaaggggcagtggctattcctgtcctgccaaatgtcacatgaagttgttacatcttccagttttttcaatgaaaccacagattcagatttttaaaaaaaaactaaaaatattagcaaactcttacactgggtgccaagcacgattttaaatgctttacatgcattacctcattaaatcacatgacagccctatgtgatggggctgtcatgattcccatttacacaggagaaaacagtcccagagaggttaaataacctgcccaaggtcacacagccagttaatggagtcagaatttgaactcaggtcacctggctacaaggttcatgtgcttaactgctgtgcaattctgttttttaaaaaacactgtgtaagtcaaataaaatacaagaggcggatccagcctggagctaaacttctggctcaaagtaatttccccaaggtcatatagctagtcaataggggcatgtctgaccttcaagcccgtgacttttcactccaccaagctgcattattttctgaaatgaagggatgaactcaatggcctccaagttaccttcttaatctgagattctatgtattaagctattctgcatttatattatgacttttccacctattattcatatttaattagaaaactcttgcatctcttccaagtctggatattttaaaggtttgctgcatttctgattttattatgatctggttgccaaatatgctttcctcccagggggcacacttcttgggtgtagtcagtcatgcaaagcaagaggaagatgtgacgagcaatgcacacactgttgctctgagacccactttggcgggcagcctgtgtccgtgaagtgaggctcagggccagttcccagaggtctggtaccctgggaggtccagccatggtgagctggctggcttgtccgcagtgacacgctgctcttcgagtgaaactcacagaagaatggatgtctgtggaaagagaggaaagtgccaggtggtacagcctgctgagctgtgtctctcttaaaaatattcagtggccaagaggtagtagacacatcccctggtggaaagtaaactggggaggccatgtgggtcatggggaaagttcacactggtttctgggtacaccccagattctccttttgttggggttctgcagaaactacatcatgtcataacgctcaggctgggggccattaggtgcaccctcagggacaggccactgtgccaggaattccacggcacgcaggcacagagcccaccagcacagtctctgttctaaacagcgacgtgagctgcaagcatgtgaatttactcaacagtatttcctaaggtctggtctgagcctggcgctgggccagggccagaaatataaagctaaataaaaccctgaccttggtctcaagtgtgactaacaggcacttaaaagatcgtaaagcaaagagatggaaacagtaatacagacaatgagcaaagtgctacggatgatgagaggaggaaccagtgggggtgggtgtcaggtggcttctgcagaagaaacacctttgtctgagactttttgggtgcacagggtcagacctgagactcctgttttatgagtctccgcctgagtgcagtgtggaggatggtgtgggtggggaggtctggaggccaggagaggctattgtgactgtagagagcccagctggacagaggcgagggcaagaggaaagaggacctagatatgagacagttcagcagtggcccgacagaaataagaggggagagtgggtcaaggatgccttcttatacaccttccagaaggattcttgctgatgaggcaagctcttgtcattttgcaggcttgctacctacagtggcattttcaccatttcctgggttttactattgtgatttttttaatactaggaaaacatcagctcccagtggcagcagctgggaagatggcagcagctcaggggtctaatgcccagcacagctctaagaatagcaaacgcctttattctacagaattggatatgataggtggaggtcctgtggagtgacttctgggtgacgaagagcagaggcctaagagccagcaagcaggcaccaagcctgggctgaagccagcttgggtctgtcaaacacagccgataccccatttctgaccagatagtggggttagggaggcaggcaggaatgggttgaaatgaaatgaaactgtcagaggagtggatgccttcactgcgaacattaggtggagttgctccagccatgagcagccctggcctgcagggttctagaacagtgacttccaatctgtgctccggattcatggggcatgggggtggggaagccgagcagtggggccctgggtcctcctcccccacccacagcagctctggattgcgttggttttcagagtgagtatgtatgtaaactgaactttgtaaaaaggagttatgtgaatgtaaaaacaatttgaaaattactgttagagaacattcatgcttggaagttccttaaaacctctgatgcagagaagcctgctgcatccttggattaggccattttcaggtggatcccgtccacaccctcccacaggtgcatattcctccggcaccaggggactcacagtttcccagcagctcctgcgacttctgggcagctctctcactattaagctgaagttgtcaacctgtgctcacacccatgctctgagctctgggcagtccagctcctccttcacacaagtctccaaaagccatgatgctgctcgagacttctttcctccagtctcagcatttccatgtcctcaaacaattccacatgtgagaaattctccccaaactgtccatcttctcccagaatggcccagagcacagaagccctcaggtggggctggacctagcccaggccgatgcaggaccatggtctcctctttccactattccagcctcactcccttatgtcccagacccagaatggggaagtcactaactagaccctgaagaggcgggagcctgtctggtgctccacaccacacaaatggccagagctgggagggctgaggcctccccagaccacctgacctcacagtgaccaggccctcgctatgtgccacacgctttccgtaggatatctcctttcttcttggttaacatttatgaacacttcttcttctcattattatttttgctaaaaaccgctaaaaaaagtcaaccagggtcataggtgaaacctttcatcacataaaaataaacagctacaatttgttaagtgctgactctgtagtaggcactttttacagaaattatatcgtagaaaccttggtacaattctatgatgacagtgctgagtacgaatagcaggtattgaggcagaaaggccagttggagactggcttagaaaagcctcagtgcccggctctaaaattcagccagcgtcttacaggtggtgaaggagaggaaaggaaaggtgtactgtcagaggtgggacctgcggagctgcagctggaagccccccattggggctgtgcggggcagcagccagagaggacactgaccaaggctctctctagtagcagctgacactatgcgtacaccaggtgcctggccaacgctgggctactacaacctgagacctcggtgttcctggctgcacagaaacacacatatgctgaggtacacattaggtaagaaaaggctgtgaacagttttaaatcctgcaatgagctcaaggtgtcagcaccatgaaggccgtgaaacagtttttgatctatctgaatggggcaaggtagccagggctcatgaaggcagttggttggcatctcttgcagctgtccttacagattaaacctgaagaacactgggttggggcgtgggggaggatacatgctcagaccccagagttactccaatctggaaaggagacggatagagaaggcattctaatttctgcatgacaacaggcaccttcttaccccataccccaagcagatctgttccccaccagttaagattacaggagaaacagggaccaaggaaaacctgtctttggacacctcaggtcatatctgtgaccactgtctcagcctcctgggaggtagctcagccaaaaggcagaaccaggcatggaggaagatccgggctccctttaagaaagagttttctgaccccagggctacaaacttggaaaaaagcaagcctgaatggtagtgagctccccaacaggtctagtattcaagcccagattaaatgacaatgtaagtctggggcaaaatagattctaatggtaggagctgggctggactccaggtccagcgggtttagctggactctaaatggacactgcaaccacactggtgctccagacataaacagccagtaggtgagtgggtgggaaaacaggaaggaagggagggtgtggtcacggctcagaggactgaggtggcctgtctgattaggacgctgcgagtgcagtggttaggcatggggtgttgatgcatcagactgccgagttcaaatcctgcctcctccgaccagctgtgtgatcctgagcaagcacccgcccatggagggtgtgctgatgctgcccagaggagaccagctatggctgtggctgtgggatggttttactattacacctcccagctgttattctcagactgagccacctcttccaatgaaagccctatttctctaatccactctatggaaatgtgactttcccaactcaaagtgggttttccttgcagcgagctatttagggatgcctgttgtgagtccttttgtggaaggaagaatccctttgtgagccccatggctgccctccagtgactggtgagtctgtgtgttgtggccgtgacaggctgtccacatcgcctccctcctgaatccccacagcagatctgcaggcctctcagcagatcaccctgcctggaatgctctccttccctctttctgatgaagctccagttctcccctgagctcagatccaaccccagcttctcagaagcttcccctgaccctgagatgggtcatgctctccaggtccaccttttctatgggcagtagaaaacagagctgggcttaccagacagaactcctgaggcggaaaccagcctctgtcccttattagctgtgtgaccttgggcaggttacttaacctctctgtgcctcagtttcttcatctgtaaaatagggataatgtcctatttcttgacctgtgggtaactgggcacaattccataggtatgttcactctgtaataactcatggttgtatacttatgacttggattgttttttgtatgtatgatctgtttcaattagaaaattactacaaaataatagcatatgctccaagaggtgttgcacattttacttagttaatataggttatgtgcttggaagagtgcctagcaccgagtggggctcaatcagtatttgctgtatctggcactctgccttgatagcactcattacagtcagattcattcttcaatagtggaaggaaaaccaagtgccccagatttcaataggttcagaagcctggagatgtctccctcacccacctcaaaagcgaagctaatggtttcgtgctaagaggctggctcaactgtctagccctggcaatattgggaccagttgatggagtaagaagtcacgatggagtctctctaccatctcctccttctctccagccatggccaggtttgcggaggaatccataacatgctgatggggatacagaagcccttggaagctctccaagatcacagccaaggggaccatgaacttcccaggacccccccgctggaggatgatggaaatgaccacactcatgccaggatggggtccgaggcgcaggaagctcctcacagagaagattcctttgtgcccatctctcctgatgagagtcttgtccccaggaaggtcaatattccgatgaagtagaagaggagcagcatgaggaagaggaagatgatgaaggtgacgaggatgtagaggaaagagaggatgcagacagaaacatcgtcacagagccacagtatcctgcagaggcagaggcagtgcaaggggatgatggcagggaacaaattccagggatgaagacagagccgccaacatggaatgtgaagcatttcagcttccaaactttgacactgaatacagtgctgaagagcaggcttcagttcctcctatgacacatgatccgtatgacacggagcttgaaccactcttccacttttaaaatggctatcagtgggatgcaggatcatggtccagattaacaatacgcagggggcaataaaagcctcaggaaagttaacctaactgttaggtttctatcgggataacggaggcgcaaaatgggtgacatgtttagaagaaactccaagatgaagaataaaggggtttgcttatctgcacttgacaaacatgaagcaggaatcccttggtgagatggtaggctggaccatgcgcactatagatctgtaagtagcccctcacctacccgctgccttaaatgtctgaccactcaaagtgggggccaaattagtgtcctcaccagcagaaagtggggtcgaggagtcaaggcacagccacgagctggcgtgattcagctcctgctcctgcctgctgatcctgtctcatcttcccttcagttcaaagtacttaatggtttgggcagttcttagcatgacagatggacagatggttttcacggaggtaggcagggtgaaaaatgtggttctgaaaagcttccagagcttgtatgtaaagatcagactgtgagagttgtcactgctggcccggctatccctcaggaaagccatttctatgaaaacttgtcagagattaaaggaggtggtaaccagttagcagagaacactttgtctcttcccagtcacatgtgggtaactggctgtgtaacctaggcccaggcccttgccctctctggtctccagccacctcactgactctacaaggcctcatagctccagggggtgagcatagacccctcaacacctgggggctccttatttaggtccttcctggtgtatccatattgagactggggctagaccctcttgagagctgcacagtgaacctgaccacaacccagatgctggaaacgagaaagcaagatcagaatagggaaatgaggtggaggctgctatagacgtggctctttggtctcctccaatgtaagcgcaggggaagtggagatgcttcttcgccgtgttgaaagtttttcgttgactgggatcagcacctcctacaatggtccaatctcctgctcagtctttgtcatgctgttctcctcaggccttcatatcttggagctggtggccttgctgttgttcattccagtcataagggctcctcctggtgctgcaagccataaaggattttacaggtcctgacacagccaccaaagggtcgtctttatcttctgttggagtaggaagcaacacctttattgatcagagcaccatgccacctttatgatcaagatgaagaggaacgtctctccagccccaaggtatgcctgtacctcgtggctaactggaccccacactgctcagccattttctgcatgggatagacagcagcagccgcaagaacacaaacgaacatctgtgatcctctagcactacagtgcattctcctcactccaggacctcctcatccttactagaaaccagtgaggggggttatgtcagtcctctttttcaagtgaggaaatggaggttcagagaggtaaagtcacttgcctgaggtcacacaaccagtgggcaggaaaagaagggcaccaatcccccctctttgaattgattaaacaccctctggctctcatggttgaagatgttgctagtgagagaactattctctagggcatggaataactggacagggagggggatgtctctccacagcaaaccctcaccataggccccagtgaagcaccacgaccacctctaccaccatcactaccatcaccaccaccatcaccgccaccactatcatcgctactaccatcaccaccaccactaccaccactactaccaccaccaccacctctaccaccactgctaccatcaccaccaccactaccacctgtaccaccaccgctaccatcaccaccactaccaccaccatcaccaccactaccactacctctacctccactgctaccatcaccaccaccactaccacctctaccaccaccatcaccaccaccactaccaccaccaccaccaccaccaccaccaccactaccacctctaccaccaccatcaccaccaccactaccacctctaccaccaccatcaccaccaccaccactaccacctctaccatcaccaccaccaccactatcaccgccaccaccatcgctaccatcaccaccaccaccactaccaccaccaccaccaccaataccactaccaccaccatcactaccaccaccaccaacatcaccacctctaccatcgctaccatcaccaccaccaccactaccatcatcaccactaccaccatcaccaccaacaccacctctaccaccatcgctaccattaccaccatcaccaacaccaccaccaccactatcgccaccaccaccatcgctaccatcaccaccaccaccaataccactaccaccactaccaccaccatcactaccaccaccaccatcaccacctctaccaccatcgctaccatcgccaccatcaccactatcaccaccaccatcatcgccaccatcaccaccaccaccactaccaccaccaccaataccactaccaccaataccaccatcgctacaatcaccaccaccaccacctctaccaccattgctaccatcaccaccaccaacaccactaccaccagcatcaccaccactaccaccatcgctaccatcaccaccactaccatcaccaccaccaccatcaccatcactaccatcaccaccaccaccaccaccatcaccatcaccaccaccaccaccatcaccaccactaccatcaccaccaccatcaccaccatcaccaccactaccacccctgccacagccaccaccaccaccatcaccaccatcaccaccaccaccaccaccaccaccaataccactaccatcaccaccatcaccactgccaccaccaccactaccatcaccaccaccaccaccaccaccatcaccaccatcaccaccaccaccaccaccactaccatcctcagcattcactggacattccagtcctggccctagtcacagagaggaacagtaacagggtctcaccagagccttgccatgcagaaagctgacagttggaaaatgcagaaagtagggctcccagttaatggcagtgaggtgtgaaggaaaggacacaggctttgaagccaaacacggctgagtgtgaatcccagctctgctccttacaacctgagtgaccatggcccctctgagtttagtgcttacttctgtgcctggagcatgtaagtccttcagtcaacagtgactgcagatggggtggagggtgggcagcagggcgggtgactacagctggaacaggctcagtccctggggaccacgtgctgcacctcaaccagtggtccccagaggtgaagttgttcgaggtccctcctgagtgtgcaaagtgaggactgtagtggagaaggcggggggctcaagtctcccaggagctgcctctctctaccccaatctgtgctcgaatcagctcccttcatggcctgagagtgggaaattcagggcacagaaaagcaaggagtgctcttctcagcaggctcagagctgacagagaagggttcccgagacagaacagatgcagctgtccagaggacctggcatcattctcagaacagacatgccaggaagtttctaagtgaggagcccccaggtgtggagggacctgtgctcatctcctgaagctgtgaggccttgtagagtcagcaaattggctgatgaccagagcagacaaaggccttgcccaaggtcacacagccattggcagcagagccaagactacaaacctagacttctgcttcttgaagcagggctgatgtaactgggtgtggccttgctacagatgaccactcactccttacatgcctccctgcatcaggcctggtgcccagtaaagaaatggatcaatgcattgtctccagaaagcttgtaggcagctctccagcagcactggcccggcctggatgcagtgtcacttgcaaatactacttaaagcacgtgtagtgcctttcagagaagccatcagccaggaggcagccctgtgactagaatcaagcccagatgcagtcattccaaatgacagaaagagaacagcacttgctcacactgactgcagatctacgcagtgctcatcgggagtggtgggaggtgctgaagtgtcctctagtctcctggcttttcatgacagccctgtgaggtagagagagctgtccctattctgcagatgtggacactgagctaagagaggcacagtgacttgccctcagccacacagctagtaggaggtgacaccatatcacactgaagatcatcctgcccaggcttgcggatttaaacttccatgttttaaagcatctacggattttattaactgtaccttccctgcctgtgggctcaaaagatggccagcagaagaagcatagtttgcctgaagcaaacagaaaatagtaaaagtcaagctaagggaaaataatcagtcggtcttggggtttggaaggatagctgttgacaagcaggcagtggcagggttggggagggccagggaggctccagggaatgggggtgcctggcctgggctttgaagatgaagaaggggaaatggccctgcaggtggaggggatggcaggagcaaaggcacagaggcagggatgcttgggatccaccgagggaatggcttggctggtagagcgaggagcccgaggaggtggcctggggccaaggcagcctccggcactctggagggacctggggaccagcacagactcctgctgggccaggcgttagggccaaccatgtggcagagttatagcaataccaggctttggggatttatttaaaaaagcccacagagcatttataatttacaataattgacaataattttcatgtattcattgccactctcccctcacaaaagtgagatgagtgatgtggcctcttccatttgatggaaaagaagcagatatcctttcctccacactccacggacaccttccacctgaccatgggctcccaggcccctcccaggctgcccactgcttcccctcctctctggccatcccccactccagcctccctagcacccctttcctgcacggtgctaatgctctgtccagcctccgacctttgaccctgccagttcctccagatggaacaatcctccctccccttccatccccatgcctttgttaactgccccaatcctcagacctcagctcgaatgccaggtcctcagaggtgctttctgagccttctgtgaccctcccaatcaatggcctcatgtgcaaagcagtccaggaggtgccagaactgggctgcaggactcagacaagctaatgtgtgtatgtgtgtgttgagcattgacatgtcccaagcaccatgcagtccttagaatgacacatgctgtggtagcgatcactctccccaccctgcagatgagaaagggattcacaggggcattaagtaacttgcccatgaccacatgcctgcgctcttggctcccagccactcctgccttcatcctgtcctgccagcttcctccaggtgctctgcaacctcagctttgtgtgtctgtctgggctccaagctgctcatactgcacttttttaagcaactctttttaaaattgtggtaacaaatacacaacctaaaatgtaccacttgaaccattttgggtttgtttttttttttgagaccgagttttgctcttgttgcccaggctggagtatagtggcccgatatcggctcattgcaacctccacctcccaggttcaagtgattctcctgcctcagcctcctgggtagctggtattacaggtgtgtgccaccatgctggccaattttttgtatttttagtaaagacggggttttaccatgttggccaggctggtctcgaactcctgacctcaggtgatccaccccacctcagcctcccaaagtgctgggattacaggagtgcaccactgcgcccagcccttgaaactttttattttccaactcattattttattttattttattttattatactttaagttctagggtacatgtacactaagtgcaggtttgttacataagtatacatgtgccatgctggtttgctgcacccattaactagtcatttacataaggtaatgctatccctaatgctatccctccccctgccccccaccccccaacaggccccggggtgtgatgttccccatcctgtgtccaatgtgttcattgttcaattcccacctatgagtgagaacatgcggtatttcgttctctgtccttgtgatagtttgctcagaatgatggtttccagctgcatccatgtccccacaaaggacatgaactcatccttttctatgggtacatagtattccatggtgtatatgtgccacattttcttaatccagtctatcattgatgggcatttgagttggttccaagtctttgctattgtgaataatgccacaataaacatatgtgtgcatgtgtctttatagtagcatgatttataatcctttgggtatatacccagtaatgggattcctggatcaaatggtatttctaattctagatctttgaggaattaccacactctcttccacaatggttgaactagtttacacccccaccaacagtgtaaaagtgttcctatttctccacatcctctccagcatctgttgtttcctcactttttaatgatagccattctaactggtgtgagatggtatctcattgtggttttgatttgcatttctctgatgaccagtgatgatgagcattttctcatgtgtctgttggctgcataaatgtcttcttttgagaagtgtctgttcatattgtttgcccactttttgatggggttgtttgtttttttcttgtaaatttgtttaagttctttgtagattctggatgttagccctttgtcagattggtagattgtaaaaattttctccaattttgtaggttgcctgttcactctgatggtagtttcttttgccgtgcagaagctctttagtttaattagatcccatttgtctattttggcttttgttgccattgcttttggtgttttagacatgaagtccttgcccatgcctatgtcctgaatggtattgcctaggttttcttctagggtttttatggttttaagtctaacatttaagtctttaatccatcttgaattaatttttgtataaggtgtaaggaagggatccagtttcagctttctacatagggctagccagttttcccagcaccatttattaaaaaagggaatcctttccccatttcttgtttttgtcatgtttgtcaaagatcagatggttgtagatgtgtggtgttatttctgaggcttctgttctgctccattggtctatatttctgttttagtactagtaccatgctgttttggttaccgtagccttgtagtatactttgaagtcaggtagtgtgatgcctccagctttgttctttttgcttaggattgacttggcagtgcgggcttttttttggttctatatgaactttagttttttccaattctgtgaagaaagtcattggtagcttgatggggatggcattgaatctataaattaccttgggcagtatggccattttcacaatattgattcttcctatccatgagcatgaaatggtcttccatttgtttgtgtcctgttttatttcattgagcagtggtttctttgtaggtctccttgaagaggtccttcacatcccttgtaggttggattcctaggtattttattctctttgtagcaattgtgaatgggagttcactcatgatttggctctctgtttgtctgttattggtgtataggaatgcttgtgatttttgcacattgatgttgtatcctgagactttgctgaagttgcttatcagcttaaggagattttgggctgagatgatggggttttctaaatatacaaccatgtcatctgcaaacagggacaatttgacttcctctttttctaattgaataccctttatttctttctcttgcctgattgccctggccagaacttccaacactatgttgaataggagtggtgagagagggcatccctgtcttgtgccagttttcaaagggaatgcttccagtttttgcctattctgtatgatattggctgtgggtttgtcataaatagctcttattattttgagatatgttccatcaatacctagtttattgagagtttttagcatgaagtgctgttgaattttgttgaaggccttttctgcatctattgagataatcatgtggtttttgtcgatggttctgtttatgtgatggattatatttattgatttgtgtatgttgaaccatccttgcgtcccagggatgaagccacgttgatcgtggtggataagctttttgatgtgctgctggattcagtttgccagtattttattgaggatttttacatcgatgttcatcagggatattggtctaaaattctctttttttttgttgtgtctcttccaggctttggtatcaggatgatgttggtctcatagaatgagttagggaggattccttctttttctattgcttggaatcgtttaagaagcagtggttccagctcctctttgtacctctggtagaattgggctgtgaatccatctggtcctggactgtttttggttggtaggctattaattattgcctcaatttcagagcctgttattggtctcttcagagattcagtttcttcctggtttagtcttgggagggtgtatgtgtccaggaatttatccatttcttctagattttctagtttatttgcatagagatgtttatagtattctctgatggtagtttgtttttctgtgggatcagtggtgatatcccctttatcattttttattgcgtctatttgattcttctcttttttcttctttaggagtcttgctaatggtctatcaattttgttgatcttttaaaaacaccaggtcctggattcattgattttttctgaagagtttttgtgtgtctctatctctttcagttctgctctgatcttagctatttcttgccttctgctagcttttgaatttgtttgctcttgcttctctagttcttttaattgtgatgttagggtgtcgattttagatcttttctgctttctcttgtaggcatttagtgctataaatttccctctacacactgctttaaatgtgtcccagaggtcctggtacattgtgtctttgttctcattggtttcaaataacatctttatttctgccttcatttcgttatttatgcagtagtcattcaggagcaggttgttcaatttccatgtagttgtgcggttttgaatgagtttatttatttatttattttttcattattactatactttaagttttagggtacatgtgcacaacgtgcaggttacttacatatgtatacatgtgccatgctggtgcgttgcacccactaactcgtcatctagcattaggtatatctcccaatgctatccctcccccctccccccaccccacaacagtccccagagtgtgatgttccctttcctgtgtccatgtattctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatagtgtatatgtgccacattttcttaatccagtctatcattgttggacatttgggttggttccaagtctttgctattgtgaataatgctacaataaacatacgtgtgcatgtgtctttatagcagcatgatttatagtcctttgggtatatacccagtaatgggatggctgggtcaaatggtatttctagttctagatccctgaactcacaccagttagaatggcaatcattgagtgagtttcttaatgctgagttctaatttgattgcactgtggtctgagaggcagtttgttgtgatttctgttcttttacatttgctgaggagtgctttacttccaactatgtggtcaattttggaataagtgctatgtggtgctgagaagaatgtatatgctgttgatttgggatggagagttctgtagatgtctattaggtccgcttggtgcagacctgagttcacgtcctggatatccttgttaaccttctgtattgttgatctgtctagtattgacagtggggagttaaagtctctcattattattgtgagggagtctaagtctctttgtaggtctctaaggacttgctttatgaatctggttgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcttttttttcgctttccatttacttggtagatcttccttcatccctttattttgagcctatgtgtgtctctgcacatgagattggtctcctgaatacagcacactgatgggtcttgactctttatccaaattgacagtctgtgtcttttaattggggcatttagcccatttacatttaaggttaatattgttatgtgtgaatttgatcctgtcattatgatattagctggttattttgcctgttagttgatgcagtttcttcctagcatcgatggtctttacaatctggcatgtttttgcagtggctggtactggttgttcctttccatgtttagtgcttccttcaggagctcttgtaaggcagtcctggtggtgaaaaaatctctcagcatttgcttgtctgtaaaggattttatttctccttcacttatgaagtttggtttggatatgaaattctgggttgaaaattcttttctttaagaatgttgaatattggcccccactctcttctggcttgtagggtttctgccgagagatccactgttagtctgataggcttccctttgcgggtaacctgacctttctctctggctgcccttaatattttttccttcatttcaagcttggtgaattatcaaattgtgtgtcttggggttgctcttttcaaggagtatctttgtggtgttctctgtatttcctgaatttgaatgttggccctgccttgctaggttggggaagttctcctggataatatcctgaagagtgttttccaacttgtttccattctccctgtcactttcaagtacaccaatcaaatgtagatttggtcttttcacatagtcccatattttttggaggctttgttcatttctttttactcttttttctctaaactgctcttctcacttttttcattaatttgatcttcaatcactgataccctttcttccattggctattgaagcttgtgcatgcgtcacgtagttcttgtgccatggttttcagctccaacaggtcatttaaggtcttctctacactgtttatcctagttagccattcgtctaatcttttttcaaggtttttagcttccttgcgatgggttcgaacattctcctttagctcagagaagtttgttattaccgaccttctgaagcttacttctgtcagcttgtcaaagttattctccatccagcttttttcctttgctggcaaggagctgcgatcctttggaggagaagaggcactctgatctttagaattttcagcttttctactctggcttttccccatctttgttgttttatctacctttggtctttgatgatggtgatgtacagatggggttgtggtgttgatgtcctttttgttgatgttgatgctattcctttctgtttgttagttttccttctaacagtcaggtccctcagctgcaggtctgttggagtttgctggaggtccactccagaccctgtctgcctgggtattaccagcagaggctgcagaacagcaaatattgctgcctgatcctacctctggaagcttcatcccagagggacacccgcctgtatgaggtgatagtcggcccctactgggaggtgtctcccagttaggctacacgggggtcaagaacccacttgaggaggcagtctgtctgttctcggagctcaaacaccatgctgggagaaccactgctctcttcagagctgtcagacagggacgcttaagtctgcagaagtttctgctgccttttgttcagctatgccctgcccccagaggtggaatctacagaggcaacaggccttgctgaactgttgtggactccacccagtttgagcttccccagttgctttgtttacctactcaagcctcagcaatggtggatgcccctccccctgccaggctgctgccttgcaggttgatctcagactgctgcattagcagtgagcaaggctctgtgggcatgggacctgctgagccaggcgcagaatataatgtcctggtgtgccgtttgctaagaccattggaaaagcacaatatttgggcggcagtgttccgattttccacgtacagtctgtcatggcttcccttggctaggaaagggaaatcccctgaccccttgcacttcccgggtgaggcgatgccctgccctgcttcagctcgccctccatgggctgcacccactctccaaccagtcccaatgagatgaaccaggtacctcagttggaaatgcagaaatcacccgtcttctgcgtcgatcacgctgggagctgcagaccacagctgttcctatttggccatcttggaactgccctgaaccatttttaagtgtgcagttcagtggtattaagtacattcacattgttgtgcaaccattaccaccatccagctccacgactgtccagctccagaaaaatttccattttccaaacggaaactttgtatctgttaaacactcactccccatctcctccttcctccaagacctggcatccaccactctcctttctatctatggatacgactagtctatgtaccccatatcagtgaaatcatacagtatctgtcctttttcgtgactggcttagttcacgcagcatggtgtcctcaaggttcatccacgtgtggcaggtatcagaatgtccttccatgttaaggttgagtggtatttcattgcatgactagaacgtattttgtttatctgtttatccatcagtggacactggggttgcttccagcttttgactattgtgaataatgctgctgaacacaggtgtacaaatatctgagttcctgatttcggtattggtggtatgtacttggatgtggaattgctagatcatatggtaattctatgtttgtgatttttgaagaactaccataccgtttttcacagcggctgcaccatttcacgctcccaccagcagcgtacaaaggttccaatttctccacatccttctcaacacttattttccatgtttttgataatagccctcctagagggtgtgaagtagtatctcattgtagtttggacttttatttccctcatgattagtgaggttgaatgtcttttcatgtgatgattggccatttgtatatcttgtttggagaaatgtccattcatgctttttggctatttttaaaattgggtttttggattgaggttgttgttgttgagttgtaggagttctttacatattctggatatcaagcccttatcaaatatatgatttgcaaatattttctcccattcccagggttgccttttcattctgttgatagtgtcctttaatgaataaaagttttaaattttgatgaagtccaaacttatctattttttcttttgttgcctatgcttggtgttgtatccaagaaatcattgccaaatccaatttcatgaagttcttcccttatgttttctcctaagagttttattatagttttagctctcacctttaggtctttgatccattttgagttcatttctgtatatggtgtaaggtatgagtccaacttcaccttttgcatgtggatattctgcttttgcatcattccttggaaagactttctttccccattgaatagccttggcaaccttgctgaaaatcatttgaccatatttgctagggtttatttctgggctctctgttgtattccactgaactatatttctgtcttgtgtcagtaccacactgtttcaattactgtatttttgtagtaagttttgaaatcaggaagtgtgagagctgcaacattgtcctcttgcaagattgttttggtggttcaaggtcccttgctcttcatctgcttgttcactgttatacccccaacacctacaacagttggcacccaattaatatttgatgaatgaaaagtaaactatctatggcatctgtgtcatgtgctaggtattagggaccaagaccaatccgctctggtccctgcctttaaggagtgacaccctgggaggaggtggctggataaactgctggctgaacaaaacagcagtgtgtttgatgacagaatgcacaagttcagagggacacagaggtgggcaggttgactctgatggaggggtgggtatgggtgcggagggagatgagggcagtttcccagagggtgaaaacactgcactgggctttgaagagtttactaggtagaaaatggggtaggggcacctgcacagagggatagagtgtgcaaaggcattggggaatgaaggcgcaggctctggaaggaagcaaccagcctggagtcacctttggggggatggcagggagtggggtggtgaggttgaggagtgatgggcagggaacccaacctgtggggcccagagcctcgtctctctccaggggtggggggcagaggggcagccccagagggcttgacttctcccatctattacagagggtgtgccgggcacccaggtcagctgacccagtggttttggggaagaaagagaataaaggacaaagagtaagatcttgtttcaacggtgaccccagggtttggctttgccactggggagagattcacagccagcgcttggtgaggcatggcgagaacccccacccagcgagggctcctcacttgcactgagaaaacaagccctgcaagcctcacagtggcctcacagtagtgaggtaggcgctgttctctcccagcttacagacgaacaaatggagctacacggaggtggaggaatgtgcccagcgaacagtaagcggcagagctgggattgaactgggcactctggcaactgaggcacctatttctttcctgggcccccatttcctcctaagtgaaaggggagggagtggcctctcaggtgccccacctcctccctgtgagtcctcaggagagggatgatgccccccggcccaggcagcattgggaacattggagcatgccctatgctggacggccagtcctatctgcagagcctgttggagcccagccacctcctcactcctggaccttcctgctctggacctagaacttgattcccatccaggtgtctcatggttagactagcgtaagctacaaccctcaggaaaatcacagagcttagagcctggtcctgagctcgccagctacacagccccagaaacttctgaggggagccctggggagatgaggatttggggaagcctagatgctagatctgctgacattctgaaagtttgtaggagcttgactcctcctctttgtgacagggtagctcctcttccttttgtgtcagcctgcacccctcctggcctgctcttgggggaacatggcccctgaagactccaccctgggattcaggctgaataatgctcacattgcagaggagcttccctcggcctccaggcccttgtcagctgcctccattccttgtcactttccctggggatgcaggggaggtgcccagcctacccttggctctagtctctaaaaactttgtccagccccctggctggccacatttggcccagtctgccaactgcacctgccagctggtcacaaggcctaacccatagcctggcttctccctggctgccgtaggctctttttggctctcatgtgcagccctgtcagctgtcaccacattcttgggagcctgcctgcccagtaagcctgtcccactccatgctgccccactccaagactgctctgtcttctgctggctgctgggccccagcacacacctcccttgactctcttgacagctgggcctgtccatcttgggcctgccagccactcatgtcaacagatgaccccatccatagcacagatccaaaattccgcttggagctttggccccgctgcctcctttggtccaaggcctttcaccacctctcctggcctcagcagactccacttgtccagaagtctgcctggctggctcccaatgccctctgtctcttttaaagtcttccctcaattcctggcttccctggtcccccttcttctgagtcgtgctgtattatcatttaaggtttttatttagaaacatcacaaacatacaggaacatttttatcctgaaccatctgagagcaagttgcaacccaacgtccatttcccctgaattcatcagtgtgtatttcctatagccgaggccaccccaggcctccctggcaggacactttcctcctttgctcaggatctgtctccacggagggatgcccctctcaacctgcttggaatcctctggggctgaatatccctctgcaagggagccgaaggcacattaggtttccaacctgatcccaccaccacaccatctccttgccatcaagacagccatggaaggatggcacatgcttttgtgtacacttatcacatgttgcctcctacttccttcctcctgttggcatatactaagcgggggtcaagatgctggcttccatcattaacatgccatgttaatgcctccctgggctacagtttccttactggcaaatgaggaattacgattaagtgatttctgaggattcttttctaataataacagctgagttttatgaagcacttactatgtgccacgtaccgtgagtacttcataggtagcatcttggttaattctcataccaaccctctaagatataatcacagtactgttatctccatcttacagactgggaaaccaaggcacagagcagttacataacttatgctcaggcagccactcagagattctagattttcatgcaggtggtccagttcagagtttatactctgctgaaaagtaatgggggcagggggtggcactatccggaatttattatttgcctgaagaggcaatcagagaagtaaatattgataattcagaaaaagaggtcaactttctacatgccaagtacattacacacaaatgccatttcacttaatctgcaacaactttgagacacagcactatgattattctcattttctagatgagaagactgagccagagaggttaaacaacttttgtgtgaggcgcagggccaggatttgaacccaggtgtgctgttgtcacctagtgctaaactgggacacatgccgtgctcagagggcaggtcttcaaggatgcaggtcattggctgtgactggcaacggggttgggggcagagtaccaggccctgggcaactgtttcatgcatctgatttcattttatactcccagcactcccgagaagcacctccacccacagagcagggaaagacactcagccacactaagcagggaagatgtggctggagcttcatgcacccttgggatgcggccaggctggaaaacctctggcaccgactcacagaggacctcattgcctcccggggccaggacttcaccccgtggactgcaaggaactgctgaagctgctgggttgggtctcctttcttcatacaccacagcggaggcccctcctccaagagactccaggctgtgggtagagaggtgctttctctctcatccaggcctctgaggccagagcaccctctggagacttggcatctcctttgtgctcctcacctcacctgcaggtgttccagcaagctgatacccagctctgggctctggaaggaaagaattcccagcagatgcctcacctcaaaccagggtacacggccacggtcctgcccaataagaagcatcctgcagcaagctcagatgaggtcctttgaccttcaaggaagatcagcttcctccttatggagacaaggcttgaaggagcctgcatagctccctcacccaggccttttcggtagactctctctgagcagcagctcccaggatttagtgccaagctctgctgtttccagagctggaaagaccctgcacattcacatctggacaagccagagatagttcatccaaaccacatggcaatcattcatttcatggaagagaaactcacaaagagcaattgcagagctagtaatggcagctgggactcaaaccccagtcctccagactctacagcccaagcctcattcttacatcttccaattgcaaatgagaaaactgtgacccagaaagggtcacacaaagtctccagctccacggctcacaccacatgacctccctccctgcagaagacctcatttcaaacaatgcccgaagatggaaaaggtaaaatgttcttgtgatttgcagctaagaaaattcaggtggacccacactgaaccccattctcagacactccatctgtccaacaatccatatgtcactttttttttttttgagacagggtatcactgtcacccaggctggagtgcagtgatgtgatcatggcttactgcaaccttgacctcctgggctcaagcaattctcctgcctcagcctcctgagtagctgggactataggcacacactaccatgcccagctaattttttttttttttttgtagagacaaggctttaccacgttgcccaggctggtctcaaactcctgccatgatctcccaaagtgctgggattacaggtgtgaggcaccatgcctgacccatattcactttgcattttagttttcattgttactgtgcatgggtcaatgcatttacagagttggtgcagacttttctctcttctatgatgtgccgtccacacatggccaccaaagacacacaaagacagcatctctctcctccttgggcagaaagaccaccttagcctgaagaaaatcagaatcacgctagtggaggcaaggaagaaagaagagggaaggaaggaaagaactatgaaggaggaaggaagactccctttgctgaacacttgtatactttctgtatgctggacctgggataaacaagcccatgttatcttactattagttctcaaaaggaccctggaaacgggtgtcattatctctatttagatgaagaaactaaggttcaaagagcaaaggaactggccagtaattactggaagtgaggctagaatttgactctgaatcagttcaaagcccaaagactttctacaacactgtcaggttcccacctgtgcctccaagtcctagaagttcagggaagtgccaataggctcctggggtctgggggtggggctgagagggtgacctttcttgaagagttctttggaagaatgggctgcatggctaaaaaatatttgaataccaccttacaggcagtctttaattaaagatagtgggaaaaactttcttccttttcttttccctttccttcccttccttccttcctctctttctccttcctcccttcccttcccttccttccttccttccttccttctttccttctttccttcttttccttccttccttccttcctttctttctctctctctctctctctctctctctctctccctctctctctctttctttctttctttcttttcttttgggtataataaacctacaaggaagaggggaatgggataggagactaacagtaaacttttggaagctggaaagagatgaatgactggaagagacagaatcccaagcctgcagcagggaaatctgggaaccaatctgatttacatcccaggatccctcaaagcctctgcaggttggggtggagggaaccaaggtaaggacgattggtggaaagtcttgttagaagctgtcagactcccatccccgccccaactccagcagctcaggagactctccccccacccaccccagagaaagcctggaggtttcttctctgcacaagttgaaactgagcccttttgaggggggatgtcaggcacaatgagggcatggcaggggtgccataaagaaatagtgggggtcgggcgcatggcttatgcttgtaatcccagcacttcgggaggctgaagtgagcggatcacttgaagtcaggagtttaagaccagcctggccaacatggcgaaatcccatctctactaaaaatacaaaaattagctgggcatggtggcaggcacctgtaatcccagctactcaggaggctgaggcaggagaatttcttgaacccaggaggcggaggtggcagtgagctgtgatcatgccactgcactccagcctgggcgatagagagactccatctcaaaaaaaataaatagataaaaattaaaaaaaaaaatagtggggaggaagtgaatgcaatgcatacagactggctgcagagacccctccttcttcccctcctccctgactttttcctgcggcttccagaacatgggaagcagaccctttaaccaagagggagactgagtcttcatagggattgattctgctcaagaagaaaggcaccactgttgaagactccccgacgaaacagccccggcagtcagctatggggaactcgccgtcaaagagcctcactcatcacttccaatcatctttgagcccctccactcttaaacatgagaagacaccaaaggctatcagatgtctgagaaacgagaccaaataaacacacaataaaggggcacttgagagaaacagaaaccacgcaggaaaaaaacctaaaaacagaacaagaacaaagccaaaaacaccaagtaacattaataacaactaacgttaatagccttagagagataagatagtagagtctatcaaacaagaacaggatgccattaaagggacattcaagaaaaaaaaattcttgaaaactgaaaatgtgacagtagaaatcaaaaactccaccttgggaggctgaagagggcagatcatgaggtctggagatcgaaaccagcctagctaacatggtgaaaccctgtctctactcaaaatacaaaaaattagcagggcatggtggcgggctcctgtagtcccagctactcgggaggctgaggcaggagaattgcttgaatctaggaggtggaggctgcagtgagccgagatcgtgccactgcactccagcttggcaacagagcaagactccatctcaaacaacaacaacaacaacaacaagaaaaaactcaatagaatggatggagacaaaaatggagggacgtactcagagaatccagcaaaaaggcaaagcaatggaaaatgtgacagagggtatgaaaatcagagaaaacagataggagggccaaggcctgaataacagcagttccagagagagagaagaaacagaggagaggagataatcaaagaactcaagacattttcttaaagcagaagtcccagggtcaccagactgaaagagccactgagtgagaaaactgacccacaccaagacccatcactgtgagacgtcatgttctagggttgtagagaagatcctaagacaggaccctaaagaaggcaacaggactgagaatggacttggagcttttaagagcaacccaggaagttagatggcaatggagcaatgtcttgacaatactgaaggaaaatgatttccaccccagaattctatgatagatttcaatctactgcaaaatagaataaagacatttccagcattttcagatatgtgaaggatcaaagtatttccctctcatgcatcttctctgaagaagaccacactgaaggatggtctctgtaagatgaggatgaaaaccaaggaaaaggaagacccaaggttctggaaagagaagacccaacacaggaggcagagaggacctccgggagtgggtggagggagctcgctggatgagagtgcaccaccatggagaggggagccccggggcagtcaggagccaccagacaactcagcggagcccctgcctcagcaagacaagatgcacagagcgtcaggtgctgctgaacatctccaatgtcttgaggggaaatttgggtgaggcgtgaatctggggttgaattagtaacaaatgtatagaaaacaaagtgcagttaagcacacatacatacaatgattatacacagtgaaaacaggaaaggaaagtaatcatggtttactttatggcttggctgtgaattatttatgatacaacactaatgagaggatagggaggtggccggaggtggaatgcgaatggcaaaggctttggagcctgcagataatgctgaagctgagaagccaagtcatgggcaacccaagcacattatgtagagatatggcaaaccaagacaatctgccaaaagagatgaaaggtactgcttctgggagtggtgaccggtgggtgggtgggggttgggcagagagaaaatgtggggcaaagagaaagagtactgctgtttcccacaacaaaatctatggaaatatttgactctttaaactccagacatgtgtaactttgataaaaactgaaagacacacacacacacacacacacacacacagagagagagagagggcaagcgagcacatatgcctctgttctctaagaagctgctttacccacaggagagagacagagagaagccagcttcctcctgggagcccagcctgattccccaggacagaaacagaggccaggatccaggcagacagtgtccaggaccagaggatgctacatcctcgttgtagctctcaggggactaccaggggctgcccgagacccccctacccaggaacctaaggctgtacccgcttgaaaaaaagtctccttttaaattttaatacgaggcaaagagatcttccctgacagggctcagagctctggaaggctctgggtccagcatactcagacactcagtctgcccaatgatcaatatgtcttttttctttccacttcgcttttcacatttttttttaaccatccatgacttgggtttcacagcacatcatcagttgtctctgatgaccggagtgagtgttccctgggaagtcctttgagtcctcagaggaaatccagaaggccagcacagtcaccctaactagaccaacacaggagatttttcttgaaggatcatctttatggagtaacaacttttccaagagtctaagtgattttctgggtacagaaattttccactctggtttcaaaatagtcattcacaaatgcatggtgggtgaagacctcaagcccataggtggcctggaatagtgaaaagaggcctggaatggggctgagagaatcctccccactgcccacccccaaaccagcatcctctcttcctcctatcatgaccagggaagtgtcttcttctcatcaatgcccctgcaggtccccagggctttgctcctgccccctgccccttctctccttggcatcatcacctgccccttgctagaaggcattccttgcagcaaacacacatgaggacttctcagttcaaacacctgtctgctccagctcacactccctccaggcactgcttccctgatttgtgctgctttcctccacagccagtctcttaggacaacgcttacacaggcacctccactcctcattttggcccataccatcagggttccatcactatggaaacagcgcccatcagtcaccagtcacctgcacagggccctgttgaatgggcacgtgccacatgcctgtcctcaccgggctgagcctccttcctccttgaacattctcttctcttggcatccaggattcacacttggctgggtctcttcctgcttctctggcgattcctcctcaatctcttctgcagcagtgtgtctgtctgccctagaaatgctggtatcctgggatcagtcctggatgcctttttcttttctttcttctccatctcccccaagatggcccatcttggcccatagcactaaattgcatctatacactgacaactctgaagagtgtattcagcctcaggcctctcctctgagggccaggctcatctatccaattgccaaatgtctccctgaacatctccacttggcctggcatctcaaaagtcacatgtccaacaagttttgatctccctgtccccagacctatttttcacttccctcctccatcccttctcaccccataaagggcaccaccatctactcagtggttactacaagaaatacggtagtcagtctcaagtggaggcttctctctcagcctccatagtcatcagaagtcctatagctcctctttccatcttcactgccatgttcctggtctaaaccattgatgtctcacctgggctttcaggatcctgctcttcgtgctgccctgacaaccactactccttcccaaagtctgggttatattccccaggagagagggggcaacaggatttggaggtataaagaaaaagaggaaatagcccagtgtgggctcatgtgatgggggctggacacttcactccccagcccattgggccatgctcagagctgcacatctacatttctggggagaagcctgagaattaaagagagagcaaggtgctgggcctcagggataaggcagggccctgatagcctagacccaccccagaagaagagcagcccctcacccagagctgagaacgtaggacccattttctcggcttctagaacacaaagggctctgctcagagaaggccctggcctgggagctggcccacgagccatccctttctggcattatgtatttcatttttaccttgaacacctgcagagcagaatggtctgcaaggaagagtccttggctcccaaccccagagcctgccccataacagaggccatctgacttcaccttccccagaccaagcctgccttcaggctgatggatgggttctcactggcctggtttcgccttcgttgtgtccttgatccttcctgagacccagagtctcaattctgttcccagattctaagagctgcagagttcagggacctgccctctcacccaaggtctcagtcaatcctgagcacattggaggaagattccttcatttaatagatattccccagcactgcctatgtgccaggcactattctcagcactggggacacagcaatgaacaaaacatagttcctgccctctcacagagcttacagtctggtggaggaaacagaagcacactagtaaatacctggagaaaaataaagcaggaaaggaagaggataagaagtgccatggagtgtgcaaattcatcgtgggtagtgtgggaaggcttcactgaagggtgatggagagaagtgagggggccatgagagtctctggaaaaagagctccaggcagagagcacagcaagtgcaaaggccctggggcagaagcttgtcttacaaagagcagagcttggccaaagcccagggagcagggcgagagccataggcagaggtcagggaggagctggagccggcacatgcaggcccgtgagggcttcgggggacacggcgtaggagcggcagggtgtgtggaccttaacaggatcactcttgttgggctgagaacggaccacagtggggaaggtgggagcaggtgactgtaggacactgtgatcacccaggtgtgagctaccagtggcctgacccagaggttgggaaaaatgggcagattctagatacggtttcagggccaagctgccaggatttgctaatgatgtaagacagagtggctttcggtccaagcatctagaaaaatgaaactgcctatgcagaatgtccatcttgcttaactgaatgagtgactttgccgctctccttcagaagatgcctttccccactgatatggtttggatctgtgtccctgcccaaatctcatgtcaaattgtaatccccagtaatggagatggggcctggtgggaggtgactggatcatgggggcagtgtcttatggtttaacaccatcccctcttcatactgtcgtcactatagtgagttctgagatctggttgtttaaaacttgtgtgacacatccctcccgctcttgctcctgctccagccatgtaagaagcacctgcttccccttcacctcctgccatgattgaaagtttcctgaggcctccccagaagccgagcagatgccaggagcatgcttcctgtatagcctgcagaaccatgagccaattaaacctcttttctttataaatttcccagtcttcagtatttctttatagcaatgcaagaactgactactatacccatctttgaccacttaaaagactttaaagagatataaagcaagtgtgggtaatgggcacagtttgtctacctatgttatacatttcccaacctccacgccaccaaccctcctgtggtatgtggttttgctactgtttaggttcttagagtggcttactgactttattttttacacacctatccaaaaggctccaacttattaccacttatttaattcatagtttaatcaatttgttccccaataaatacacagaggtaacacatattcccaaagacataattctaaatctggagttcacagcaaaatgggactaggcacagcagatgattaggctgaaaatcatgctacacttctgggtttcaaagtccaagaagaaatggatttgtaaaaaaactattagaaaagaaaataatctttagattttttaaaactaacactattctctccaagctactatttcatgaaacacacaggtatgtgtgcacatacacaggcacacacacacacacttcaaaatgtacaaatgcactgtcacaaaaacgtgctgcgtacactgcatgaactcttaagacttggataaaaattaattcagctatagaaatagatgagatagaaaagtacactcgttaaaaatgtaaccccttcaactggaacagtaatgaattaaataaacttttaaaataatttctttaaggaatgtcaaagaggcctgagacacagttctgcagtatgcgctgtgctgtggacaaagggtgggttcactgatgtgcaggtggaccgcctcccagatacgaagttggatgcatgacccggagttcagaggagaagtccttggagatagggatctgagtgtcatcaacctgtagatggtgtatagatcacgttgggactgagtttagaggaagagcacggagcctggggctgggccatgtggagccctaatgttcagagatcaggcgatgatgggactcactgaagatggtgagaaagtgtaaccagtcaaggaagaggaggatcaagaaagaaggtgatagggtttgtctgtgtccccacccaaaatctcatttgaattgtaatccctataatccccatgtgtcaagggagagaccaggtggaggaattgaatcatgggggcagtttcccctataccattctggtgacagtgcatgagttctcatgaaacctgatggtttcataagcgtttggtagttcctcctgcatgcatttttccttcctgccaccttgcgaagaaggtgccttgcttccccttcaccttccaccatgattgtaagtttcctgaggtctccccagccatgtgaatgagtcaattaaacctcttttctttataaattacccagtcttgggcagttctttatagcagtgtgaaaacagactaatacaggcagtgtccaggaaaccaagaggacaaagtcctgcatggacgagcgaaggattgactgtgtcaaatgctgccgatggctcaggaaagaatagaagtgagaactgactactgacttctgcaaggtgagggtcatcattgacttggataagagcagcttctgaggtgtgaggagcccaaaggcccaccttgaataggtctgagagaagccaggaggaaagatacggaggtgagcaacacagtcaccttcttctggagtttttctttaaaggaaacagagaaatctggcaatatggcccttcagccaaagtatttttaaggtggaaaccttaagtctgggtatgcttaaggagcactctcctggcccaggagagtggcaatggctggagtgaggtactggggtaggtgaggtgggatgggagccaatgccctcccataggaggtgcagcagctgagtcctgcagcacgcagggtctggcatggactcctgggatctcaccatctgaacttatcattcccttcggacataagccccaataacacaccacccaactgggcttggtcagccaggtggttcctatcaattccagtctcttcctcttccgtgtaagcccactgggctgaattcccagctttccttgcaataagtgaacttgagttaagacaatatagtcattactctcaaggaacaacataactttgtgtgtgtgaaaacaacactgcttaacaaaaagccattctaaacaaccaaggcaaatgcacaggtgctgggtgagagagccatcacatccctgatgggcactcccaggggctgcctggaaaatgcgggctttgttcaggtgtggaagtgatggggaatgcagagggggccatgtgccaggaaactagtgcaataaacagagactgatgcattgtgtgtgcaaagcattaccccaggacccaagtcaagaagggacttgggaggagacagaaatggatcttagcaccagtgttatgacagaagtaacacaaagaactacagagtgtggagggatttgggaggctcgttagaggagcagggctgagtattggcttttgaaggctgggtaggatttggcaatggcagggcccagcaggcagcaaaaggtgaagggcgacaggaacaggtcagattctgaggccagcactcacaggctgagtttaaactggatcctgtaggtgaggcagccacagacggctctggagaaaagcatgacacaggcagaatcatgtttagtgatgctcagtggcaccaactttggagttctagagatagggtggccagagcagtggcagagggagtaaagagaccacactgagtcactgactacttcatgcagacaccaggattggggtctaactggaaagggggagaaggcgtccaagacaatgttaaggttctgagtgtgaagggctgggtgtgtcatctgagatctggatgtggaaggagatgctgttggtgggaagtggaaggcttggtttgcacatgctaagtgtgaggtgtgaatttcccaggcaaaaatgctcaggaggcatcaaaaccagtgtctgcagttcaggggtgaggtcctggctggagacccagatgtagcaatgtcggcacagagatgaggcctggggctaaggagatgggtgacactaccaagggagaatgctcaaggcaagaggaagtgagtctcactgatcaggtatgggagctgccatcacacctgtagcaggtagactgctgggcagcgtacccttcctctccacttgtctgggtctcgcccaccctctgggcccggccccacccactccgggaagccctctctagctattccatcccccaggcatccttcctttgctgtgagcttctcagctctggccatccccaccttagcagtgggtcttgtgttgccaccttggtgtagtccccaagcaccttgagggcaggatgacagttaacccccatgggacactgcattttctgacacagagcacccaaaaggcactgattaagtagatcctcctccctgatgaattaataaattgatcagtcactgaaatggaggtcaagaaagaaattaaggcaagtttaattagagattaaaagactcatatagcatctactcttttgtgtctggcttactgattcatgatgaactaggtctacatgtatcaacatggatgcacgtcaaaaacactgttgagtaaacataacaagttacagatgtatgttaaaccaatttgaatagtcatgagcactatatctaccaaatatttcaggttctcccaagcacacggtaggaatgcacttctctactcccatggagctaggtgaggccatgtgacttgctttggccatttaaatgtgagcagaagcttctgggtggaaccattgttttcttcttcctctctcagcctctactggcctggatctaaggaacagagctccatagcagatccttctcaaatgtgtacaggagtgaaatacatatgtttgttgtattaaaaaagaaagaaaaaaaaggaagaactgagtctaaggcaaaactgtgggattgcagaggagtgtgcccagtgattctgggtgtgggcactcttggcaatttgggggaacaagaggttgtaaggctggtggaatggaaggtcagcatctctggcctcgtccctgaaatgccagttatgtggcaaccaaaatgccctccccctccttcaccatttccaaacactctgcggggtgatgccagccccaagagaaccatgaatgtagaagaatcaccagaagtgagagtgggaggcatggtcccagcttgagatagccaggctgggggaggaaaggatctgacactataatcagttccatacgtgctcaaattgcatgtgacaagttgaaagggagaggataccttccatatctgacagaacagatgggactgtcccagacagagattgacaaaatggatatactagtagtaaaatgcaccaatgtccattttttgagcagctatgaattatagccttcatatggggtctcacaaggtcctctgaaaatcccacatgttattttcccccttttacaaatgttattctcccccttttacagataaagaaactgagggcgggagagctggggggctagtctcaggcagaacagaggtaagtggggcagagatgacagaactcaaccgagaggattctgaagcagagcaggtgggactaagtgaagacctggaaggaggtggagagggagtaggacccataccagctggaggaagagaagaggacttgtgggtgatgttccccctccttcagccattgcagaccgtgtaggtagagacatccagcagggagctgggcacggagtggctcctgccagctgcctttctggaggctcaggcttcctgaggtctcagagcacctgcctctcagggaagatgcgaacctccccgggcacacacagactgctgctggggcaagctcctgggacaccaggaaacactcagcagccctcagagaccacagagaacctctgaagcaagaaggaagagggccagtcgctgtgagcaggcgcttcatcaatcctgcctctgtgtggcctctaagggatccagtggcatgagaacacagagacacacgagggcgctctaaccaaacagcaggaggacccgcgtccctccccacacggaaagagggttggcattttcaaagacctttggttcagtgttttttcaacgcagctgctattggtattttaggcagtaggtttcaggggcatttgctacccctggcccccttcccatcattgactaccctgctgcccacatttccaagcaccctctctcctgagagcccctgctggtcagtgccaccagaagatgccaactggtggccctggggagggtggcagtctctgttgtcccccaaccttatggaggactcccgtgcctcccacgctgaccctgtgagttaggcgcttgcaggtgctagaggatcagaggcccccagtgacagccatgttggccccagctcatggggactgtcctgcacaggaagcgcattttcctctacgttgttgtccttcagggctgtgcaggaccaggccaccctgatcacaccagggacacagacacaggaccctgagacagaacgccatgggacctgctcacagacacccaaatcccaggaagcaaacatgtggccacacaaaacacagctggcacaaaacttccacaaagcacgtctgaaacacggcacccttccagagcccagacagtccctgaagctgtgagctctgaaacgtttagaccattcgtttcccaaagtcaagcatcaaaggtgaataactatgaatgagattcaaaatattcaccaaccattgagccctgggccccagccagtcaggatagggaccagtggaaacacctggtgcatacagtgtgcagtcagccctgcaaacagcctagtcggctgagcccaagtgccccatgggaaaccagacatgccaagatggccattgggcagtacagagatgacttttggagaatacatgtcaagagagacagaagtctggacatttgctgggatactgggatggcaactccaatgcaggaactagaaacctggccaggatctgagaaaatgaggggctggagaaagacccagacctctccagatcctcaacaaatacccagcatcacccatccccaccaagaagccccacggcattcttaaacagaggggcctgagagtcccaggaaggtgatgtctgctgaaaggcatcgctgggaccacagggcacctgtgggcagagcccttgccaactgagccactgctgcccgtgaacaccaatgggcaccagctcttattccacggaagcagacgatggaaaccaaacatgagtcttaccctccttcgaagattttgatcctcgccggctcccctctctgggaggcaggagcatcctcctccggctcccctctcctctcttcttccttctccactctagctagatctttctggccttccggggaaaccagtgaagggaggtgaacctggcccaccgcaggaatgacaaaatcattgctggttaaaagtgcatcctcagtcacgaatgcaatgctaataatcatgccttacacagtactgcacaagtacacatatgcaatcttcacactcccccatgaagaggtgctattagctccactttacagaattaaggaaactgatccccagagagaattcccttatccaaggccatgccattagttggtgttacagctggaaccctgtctctttcatgttaacctcccataagacctgtgtttgttctctgtcttttacactagtctgggaactcctggggacaggtcctcatcttggtctccttgggcaccccagaaccccatacagggcctgtctcagagaagaggcttaaataatgttgaacacatgaacaaggctccactctgcctttggagatgaactggtccagttcttgtttatagatcagaaagctaaggtcacccagcgagttaagggcagagctgggagcagagcacaggtctcttgcttccaggatcttggccctcctgagctagtaccaaaggccaggagctgggctgaggaccctgaccagcaggacgtccccaattccaccatagagacaggcacagagaggctgtgcaggctctgggctgttagtcctgcaggacccacgctctttacagagccacacctcagtgatgagagctagcttaaggggagagctggcattggctttgtgcttcctggacatcttccactatcccaagaacacgtcctgtaaacactgcagtgttgtcaggggtgggtgcacttttgcctagggagcagaaatgctgtgcttaggggctgggagtgagaatttcctcctacttcatgccactgtcattaaggtcatgaaaaaccatgctgtttccatccagtgaatgaagcaaccacatttcctgatgctggggcaatctaagaacggcagtcccctttgccagccaccacacctgcccccacaaggacagcatggggctaggtagaaaggtgactggctgggaatcagggagtctgagttccagcaccagataggccatggcacactgggctgccgtttggtggatgacttcacctctctgggcctcagagtctgaggggatttagaccatcttgaagatcaattccagggcaacttctgtgactcagtgaccaccaaataatctcttcagatttggaggaggggagtggaaaccgagcaagaatctggactgctgctttggcagaaggcagctagttttctgcaatacccttgggtttccagagcctaccatttccactgcaccccggcctgagatctagactgtccatgtaatgaccaaggtgcctcccacaggcaaacagactacttctccctcacagcctgccgtgatatctgggccacactggaggaggctggtttgggtggcagtgtaccactttcccaggaaacacagtgttggaactgagcagggaccagggatccattttagcttttgatgacaacaatatgaataagtatagttaaaaatacttactgagtgccagtgtggcatacactgttctaagcacactccgcatgtcttaactcatttaattatctccacagtcctatgcgctaagtgttattattatccctattttacagaggatgaaactaaggctcagagaggtgaagttattggcccaaggtcacatagccagtaggtaaggtagtgggattcaaacctgggcaacttggtacctgagtccttgttcttaatcactttgtgacagtgctgtgttgttgtcaaaatgattcccaaggaggaaaaaggaaagaatgtggctacaaagtggactctgaacaagctggggtttctccagggtttatacgtggaagaaaagatctatgaccaaacaaaaacatcatggggtgtcctagacctgcatgaagatggtttggaagagcttcaaaatgctaagatagacctaaggactttttcagaactactaacagagaatggaagccgcaagctgacaaatgtcagctcagtacagtaaagaaccttcttagagcactgtccaaagatgaattggactgcatcatgagatggtgagttcctcttgctggaagtatgcaagcagagaccagagagaggtgtagttgtataaaaggccttaagccatagaccatgtggttatactaatgtaccagattggtgcaattctggaaggaaacatgccagtgaaccaaacagaatattccaagaaaaagttcgcaggttttaggagcactataaataaataattgccgaatccaaattaacacttcctttctcttaaatggcctgtaacattttcagtcattagaaactagaggcagcttagataattcaaaagggcattggagtaaaatctagttttgatctaggctctgccatttactgtgtggccttgtgaaagttacttaacctctcttgtgttttggtctcctcatctatgaaatggtgatattgcaccctaactttcaagttggttgtgaggagaaaagtaacatttagcatagtacttggtacataataggtatccaaaaagttagcagtatgaataattataacagcatcttgggagtggccacagctagtaagagacgctgaagaggaaattagcaggacattaacacaaaagtggaaatcttggtcagggatgtctgtagactgacaaagacatctagggaataaatttggaaaacagttctgtgaagaacatccagtcaagctaaggacaaattcaatgcacaaagttcactgaatgacaaaaggggaagatatgagagcacaggaaattatagaacacagttgtgctcacttatctacaatatgaatttggtttagggaatttagacctaatttggtcagagcttctggtctgaagacacactaataaacattttttaatttgcagtcaacttttaagattttctctcctcaaataattaaaagaagaaaaatagactctttggagtcagataggtctgggttcaaattctgggtttgttcaacatttgccagattatcttgacctttctcagactctgaccctcagttccctaagctatagaagggagatggttatgttacttcagaggtggaggtgagcagtgaccagattcaagggcccagcacagtgtctggcaccatgaggctgctcagtaaacaagaccagctgttattccacaaatgccaagtcagcacaatccaaatccctaggctggccttgtcagggtatggtggtggcttttgtctgacatttgaaattattgaatttcaaacttgctgagctttcaggggacgagttcattttatagctcctgatgtagcctcagatcaaaggcaatgaaagcgtaaacattagcgtttcttgaccacgtagcacaaataggtcaaactgtgagtggcattgccatccactggtaaggagggatactgcagctcagctccatttgctgtcttactcccagaaaaggaagaaggaatatttcaggagttgtttgtgccaaattctagaatcttggaaatgggaagatttaaagtggtactagagaatggaaacagcagatgtaagaattaagaaaagcaggaaaagactaacaagacaagggatatccatataatgaaggagaggtaaaaagttctaaaattgctacaggcattcctgttagccaagttttccaactcagtcttttggaaaatttcttttttttcttactgagactgtatctttgatttcacaacagaaattcatggcagagcaggatcactttatggctaactttattgaagtgtatctattccaatgatatgagggatacagtgacaaagaaactcaataaacatgtttccttgtaaggtgaccagtctcagctttcagagaggaaatctgactactagtctggctctagttctgcaactggaacctgaggatactgtggctttaaaagctcgccaagtgcttttgcaaatcagtgatgagaagaaaaacaaggctgaacttacctctgtcatgcggggcttgcgggagctggatggcacaagccttcctgcctcaggatgcggagctgtggccatggtgtatgtctctttgctcactttctgcttagacctcaggagggacaaagcagctttagtggaaacccccggaaggttggggttgtacaaacttatgcaccaaccagcgtaaacagaggacctcctatctgcatgctggatgtgatttggcttaatgtagtttaaatagcaccaactgacattagtggttgtgtggaggctggggaactgcagtaccttctttgagtccgtaccttcttgtgacttggctggtctggaggacgtttctgacagaggcagagagctcggaggtgccaaggaggggagatcaggttgttccttggaatcttctttcttcacgctcagtggggtcaaccctcttcggtgaggtttgccagatggctggggatattccttcaaagcttctgagcctggggctgtcccatgggacaatgcagggtgagggaggggaggaatttcctttgtgtcagatggatctgaggacaggctggacagcatttctagctccctcctgccttggccctggttgcctaagtgggatttctctggcctcttcccatcctcggtgctggtaaggaccacactgcatggttttaccagctcaagtttttcatctgccttggaagcctcctcctccttcactcttttttgctgctgggtttccatggtaagttcaaggctgccagctggtgaaaggacacgtttgcttccccctgctgttgatgaactcccctccaggctcaagatactctctgatgacagggaagtgccttttctttcaggtaatgtcacaggcactctcaggtatggagttgggaaagctctgctttgctcttcacttaacccagaagggccgggcccaacctcatgcacatctgcaccacatacagtcgtcccctttgatgggggttcctcaaacttgggaagtgccacagttgctgagctgccttgggactgggtgaccaagatctgggaaagggtggtgtacattgcgctcccataggacggcatattggtctgaacacggacaggcacaaccagggacaccatggtgtctggacaggcaggcagggccagtggaggagctgatgtaggtgctgaggagctggctgggggagccacagggggtagccggatgtcactgctgtactctgtgctgggggagaggccagcacttcctgttgccagtggggccaggctggttttgatctggggcagatggctttccacatcaccagggagctgaagtgcaaactgggattgcagaggcaggaaaaacccagaagacagtgctgaggaggtcgggtatggcatggggaggaaggaagggggctgcctgaaggggatgttggctgggtgaggcatgagctgggggagatggagttggcctgggtgcagaacagtaggctggagaggaagcggtggggcttgaaataaggagggaggaagtgggggcatggagtatggtgaggacaggaggctggacatggcctgggtggagaagaattctggagactgtcctggctcatgctgcacgagatgctggaaggagaaaagggagactggtgggggcaggtatggcttctcatgcaggggtgtctgggcaacggggtggtggaacacttgcagtgcttctgtgtagggcacagtgggccccaatgggggcctgtcctgccctgggcccttgcctcccgggggtccaccatgtgaggtggccgcagaggaaatctgggacaatgagcttttggcagagggtttactggatgagggctgtggttcttcgctctcctgtcttcccttgggggcaacctccaactcagattctggaggcctgctcagagaggcctgtctcaccaagaagcattttcttctctctggcggggccacccgcgctggtggagccactggggctggagcagaagggcctgtcaaggacaagctgccatagtcaaaggatttgctgcgtgtctcggtcatgtgggcagaatgggaaacgttggggctctgctctgaggctgacctccgcatctctcgggcatgtgggtggtggctggggacagtcaacatgtgggtgcccaggggtttggggcgcatgtcagatgagggactgggggcctcggctttcccatggtcatccctctcaaacgaggctgagcggctggacccactcaaagagacattgctttcctggctcgggctgcgagacagaggcacagaggactcgaagctggactcccctgatgattgggccatctctgccaggcgcaacctcttctttttgggtggcagcttctcagctgggagctgggcaagtgtctggctgcgctggggccattggaactcctcagtcttctcaggttccttagggggcggctctggctctgtgtccggccggtcaggctcctcagttactaggatctcaggaacctgaatgttgggctggcggaccaacttaggctgcagggagtgagcagagcgtccgtgtggggcaggtgggggtgatgggaactgggccagaggtttgtcttccccttccaagccactcggctgctcgagagaatcagatttctcaaaggagctggtgtgctggatgacagaaatttctttggacgttgttctcctctccttccctgattctgaaccggaccctggcttgggagtccttggctggaagcccgtgggtccctccaaggagggcactgatttacttggttctgctggtgacttggtggactccaggggaaggttccgagcagcatcagatggcccggggctgccaaactgactttttgtggactcaaaggcaggtggctcttcctcgtccccaaggctcttctctttcctcctcttcctcagtggagtgagttccagggtggttcccagtttgtaatgcatcatttgggaccacggctcatgctcaatctgactcttttcagcttctggagatgtgtgggtgcctgcagagatgggctttgcgatctgaagctctgagcagtagtattttttgtgggcttcgtagttatcccttttcttgtaccgagcaccacatatgttacattcgtagatcaccccttttgttttcaaacccttcttggtctttttggtaagctcgctttccttgggttccacttcgtccgagggcttggaggctgtgtctttgctgcttgggccaggctcctcagaactgtattcccctcccaaaggtaattcgattgccggctggcgcttcagcatccgggggtgggaggtaaacacgtgactgctgtggctcagggcttcggagtcggtgatatggtcatcgaaggagtagctacctcggaaggggtggtggggggtgctgatagtgcaggcggcagaaggcattgagtggcttctcaggagaggcacagggggggcggtactgggcgggtgctggaggctcagcagtgattgttcaggcttggttttctcactgtgggatgacaggggctcccggtagaggctggattttggggactccatgctgctgcgcctggacagtgagctccgccttggcttcacgctgtcgatctcgctggtgtccaccacggcctcgttgatggtgatgagcttcgtgatgtgctcgatcacctgcgtccggggtacagacaaaggcaccaggctgggcttgtcttcggtggacaggggcaggaggggctgggtggaggtggctgtcagcatggcggtccgctgtcctattcgcccacacttgccaaagatgatctcagcgtaggacttggcgttggtgtttggggggctgacctgctgctctgcactctcggagcgagagaaatacccagactcagtactccctttgctgcctgggctcagaaacgcctgctcatcgatcaccttcttcctctcgcttaagcggagggccagcttctgcttaatcgtgtgggtgtcttcaggtttatggctcagggggtgctcagatgagggttccacaaatggaggggggtcttcgagtgactgggctgtgctggactgggacagggaacagcgttcgtggctggaactgtggctcccagagctgtatagcccgctggagagaaggggctgcttgggtcttggggagagctctgcagggtgaccagaggtggcactagtctcctcttcagaatctgtgctttctccctcagtgggctcctcaaactcttccccagggatccgctccatctccagcccatgtgggtacatctcgccacccatgcctgaggccaggcctgctttgatgcggtgggcatgggacttcctgtgcttgtagagattactcttggtcttgaaggagaagccacaggggccgcaggggtagggcctctcacctgtgtgtgagcgaatgtgcttctggagcacgctgggcttggcacagggccggctgcagtactggcagatgtacttgcctggcttctggggcttcctctccttcttgtgtgcctcttctgtgggcttcaaggagacctgggaaggacgaggcacgaagactttggggactccaggaaggtcctcggggggaatgatggaagcgtgggaaggaaggagctggctctgaggatggagcccaggggccacgaaggagccagagggtccaggtctcatggggtcaaccagttgccatgtggacccctccaggagatgctcaggtttgccaggcgacatgaatgctggtgtcagagggtgctgcggaagctgtgagatgtggacggatgcttcgatggggggccttttggggggcttctgctgctggcccgttttctcctgagagccttccctaagaactgatgaggggcccgggaagggctgcggggctaagagctcttgggcggggctctcttgggtggcagctgtgccgctgcctgggtatgggacgctggaagaaacactggtctgaatggcctctcctttggtcagccgcttccggggacttccctcagccttcttggtgcccttgacactttgttcaggatccatgaccttcacaaagacttcagatgctattcagggagagtcagggcgggctgcatttatgaataatcccagtgtcccaaggaggtgtccagctttggccacattggtcaagagctgtgggagccaaacccaagacggctttgggagttttttgcaagtgtcactggctgtgagtggactcggagcaggtcatcagggcccacgctattctattggtgaggcatggccctctactttgcagacagaaaacgcaccagcactttctgcctgaatgtctgtcgggaaaacgtcatgaaggatgtcagtattgccattgtattgtttcagctggcagtggcaggtggcccccacgagtcccccgtgtgctatgcaaacggttgaaggttggagacatctgtgtccatggcccagtcatccctggtcctggcacaagagatgccacgctggatgctgggggtggctcttctcccctttagttctgggttggagatcaacggccttggaggagaaatcacgctcttcttctgtgtgatagatgtacacacacacagaaatacacacacacaaaagagaagacagagttactgggactcatgcacagcctgggcagcccagactcggtgccacacctggctgagacccctcaaaagttaaccagggaaactcaagcagaaccacaggctccggctccacatgtccaagccctgcaattctttcctcccccgctcccatgtcagtgttgggtgacctgaatgccagtgtgtttctgaggactgtggccatgtgggatgctgagaacagaaggcaaagtgggctctgggaactgcagggtggttagggacagaggcctgggctctcatctctgttttgtgatccactctgagtgggtctaagctctctaagcctcagttgcctaatcggtaaaacagataacaaatcctgcctcgactgtgcctcggagctgcagtgggcccaatgacattggagatgcagatgctgctgggtgaactctggatggggccatggctggtgcaggagggaagtgcctgtggtttattcaggggtgagttttccaaggggtagattattctcaggttagtatttctctctggccctgggttctgaaagtgtccacaagggacatcattcactgctttttaccccattgctaacccgcaccccagcccatgtttgaagacaaaactgcaaactactgccacagcctgtgagaacttacaatctgacacagctgtgaccatttgcttgatccaagcaattgccaggaggatcattctggaaggttcctctggctttgcagcctttccttgtccagtcagtgccctggggatgccatggaaatatggggatcattgccctcaagtggaggagcaaagttggtctgcatatagccccaagtgtgtgcctcctcctagggccagctgcaagcagggcagtctcagcttcctgggctcaggtgcatcctcagggccctcctccccaggaacagggtcggaatcccaaggctggagtcaccatggactccatctcacccaaccacctgactttggacatcatgaagatggcttactgaaggtcccgtgttgctaacaggcagtgttgccacctggacccaggcctcccatggccagagtttgttccccagccccttctcaggtgtccatcccctggcatcccttggcgaggccctgggtgagtgatgagcatctctgtgcttgctttttctcctgtgagcatgccctacccccggcatcctgccctcaggctcccctcatgctcacactcttcgtttcactaggtgtgtgatgatacagacttgaaaatgccacttactacatttttgcaggtgctcagaagacgaacaagtctttaagactcaaataattgtctcttaaagggcagggccctcggacactgtgatatgctttggaggagcaggtgatttgatcttttagctaaaaagcatatcctctaagttcactccttttgtgtgccttttctacttggtgctacaaagaattcaaagtaactataacaaaaccatatttatagaagaatgacaaactataaatatgagaaaatcataaataagaataacaaatcagaacaaagaaaatggaaataaggcaaaaagtcaggattggtgggataaaaagagtactgctataccaataataaggacttatggtgtttctataattcagctatatatttatatatgagcttcctggcagccaaggagaaaagggagatttggtccattatggagtcttatagccagacaggatggaacatctaagtttcttgcaaaactttttcatgtagcacttcagtcaggagcagtgaatgatgcaggagatcatttatgtcttcaatgacacccctctggtcattgaatacagtgacggattcaatgacatccctctagtcattggatatggtgcaaatacagtgattgatatttgtcaatgaaagactgtgtatcagcagagattctcctatgagcagtcaaaggcctcctgtgacttgtaccaaagcaggctgagtgtggggaagacagacaaatctcatttcattagattacatctcagtcaacagggtggccatataagataccatccaaactgggacacttggagaatgaaatgggaactactaacagtcatcgaggaacaacaggaataaacaaagacagtcccaggcaaaccaggacaaaatggttacccttacaattaatatttgccttacggccaaaactaggcataagtgccaactgtctctgggtgtctcatacatacttttgatctcttctatggagactaaagttacaccgtgatcttctgatagattcttagagactgactgtctagtccattcctctcacttgacagaagagactgaaggctagaaaggtgatatgattttccctgaaaatcacacgggaatggtggcaggactggaccatcctgtgcctcttgaccccccagccaggactgtctcccacctcaattaatagaagttctctgtggcttctgtggcatgatgcgcactgcagtctatggcccctagtcctatggaagcaccggcatggccccaggggacatcgctgtatccacggcaagagggagtaaggaattgtctagcatctgaacaatagagttgccctttcaacctatgtcctaaccacactgcagctgctggacagaagaaaggggagcccagcaaaggtcggggaactcgtcctggcagccttaccccaggtcttgcttacctaagctaaggcgggcagaagtgctgagccttctaaaaatcagacatggtagacatggtttgcagcacagagagaactgctctttgggctgggctgggcctcctcagcctggctgcactgtgatggagaggcctttgggtgctatgtgtggataatcaagggttggctatacttactattcttattgatcctttcatgcaaggatctgagagcagccccaaaacaccagctagtggtaagctttgcttcttccgatggatggatgggaccctgcagcatgactgggtggtgaaatgatcaatctgagtgggggtcagctggccaggcaggactctacattgcttagtcctgccttctcccctcactgagccacaaggctctccttggcaggtggtggagcgcccagcagctggggtttggtgcaattcccagggccaggtgggaggggcagggtagatgaaggagacagtcagatgactgctgcatcatcagatgactacagggccagcactgcctgcccagggtcagtgtccagcctgcacctgtgggctggacatggtgtttctccaagcagaggcctcctacccacacttctgagtggggagcaaaaaggccacaggagcaccgttggctgccagggcgcagagtgagcgaggcctgtgagctggaggggccaccctgtcattctgcacaacaggcatctgagccatggtggagggtggctagcccaagccacactggggcttggacttctggactagtgctctctgccagcctgctctaccacaccatgacaggtctgaagtgcttaagaggaggggcagggggagaagggcagccaggaccacaggtgcagatgtaggggaacctgcaggacctaaggagacttctgtcttggaatggattccaaatgtggtgcggcataaaccgaaggaccgttctaatgactgtgaccaacagacactaagaaaatggttcttttctaccttctgtggttctgagggtatgtgtgaaattttaacacaaacttgaagtgataaagaaaagagccacttttccagggaattggtgagagcacctgtaaaagtcaccagagaaatgggcccaggagctgggccaacagaggcctgaaccccagaccagaagaggatggacagcctctactgatggtcacagaatgggccatgaggccagtgagagctctcgctcagagaccagcttataaccctgaggggaacctgagcttcagcagccaactggttagctcccacttcaagaagcttcctttggtctagctgtgggagcagcccaataggaaggagatcgggacttgctggggttggagccacaaaagcctcaggggagtgggaagtaatggaggagcccggggccaaggcagggaggcctgaagctctggaaccaaactggaaagcaccttctgtatcgaaggcgtcaggacaacatgaccatggcccagggtggacaccccagaggacatttccagagggcaggtgggagatgggctctctcaggtagacaattccaccagtcctggcaggaggccagcttgaatctgccttgggctctagactgaggagctggggtccccggtcaaagttagataaggctggggcaagataggggcaggggcctgatgtccaaggagctgttaggctaagctggccccaggctggtggggcttaatacagctctttgcttgtaatttacttacacacacacacccccacatatcccaacatgccaaaatctggtcaaaaattttactggcagtaataaaacatactgatgtcaaaaatataagaaaactttcctattaactttaatacctgggaacccagggcacaaggccacaggctgaagaggaggcactcagtaaatattcttatttaatgacctagcaacaaagccagtgccccttctaaaaatctctgtgtacaacactctgtgtgtgtgcatgtatgcatgtgtgtgtttaagctggagcagaattcttcacttgcaaaaaaatactaaaagtggctgtgggctcaggtggtggcaaaacaagccagatataagcatatgggtctggagactaacagggattggtagtcaaagagtcacagaaggatgtctgggcaaagagagaggccaaggtcaaggcggagctctggctgggaacagggattgtggcagagactgaatatttcttccattagccagttctctttcttgtagtaatcaaaggcccccaagctgggtctatggccaccagctagaggctgcctttcccagcctctcttgcagctagttctggccaatgatgtatgcaacttctaggccacagccagaaggaaaagtgcttgccctccacctctccattttgtcaggaaggaacatggatgtggtgggggtgagccaactgtgaccacatggacaagaacatcaccccaaggaacagtgggacaagaagacaagaagacagtgtgaagcaaagccacctgcccctgagagagacatacatctttgagcttgttacttggtcccttttggagcagttgaacaaatacactaactcatccaggggattggagtgtgatgttggtgtctgggaggctgaaaagggtttgccagaacccaggtctaggtaagtggggacacagggagaggtagcaacacagatcagggtttagttctaaagcacaagacaggcacctgtagcaaggtaagcatccagccactaaacccatgcatgcggcaacacagcacagcgactcccaaggtagctttgagactcaggcagcctgcagctgaaccctggctcctccacctcctaactgatggtcccctaatctggacacccctctaagccttagtctccccatctgtaaaaagggacagtaaaactgtcatgtgtggtttaaattgagttgactcatataaatctcttggcatggcacctgacatatagtaagcattcaataaataataatcatcattgctattggagaaagcatttctgtggaggggctgtcatggctgtgtggaaagatctctagactagattccagtcctggctctgctgcttttaggctgacaggctgtcataagactgactggggttaccatgtatgtaaagtcccgggcacacagctggtgctcaagaaatgagaaccaaggttgaattcggaggtcaaagcagggcccccacagaaaccagtgtcacactgacccaccaggatattgggagagacctgagttcccctaaacaggggaagcattggttcttgagttgggcagagccttggcctgcatgctggagccaagtggtcctagcagtggggataagaacacaggcaggcgatcaggtggtgaaaggtctgatggatctgactttatgggatacttttcagattgaaggcttcataccaacccagggcacaagctagaactgataatcatggatgaaaatcatcacgatcctggcacacagctttccaggccaccagatccatcttcctgactccatggaagccacactagatggttctcctactgagattgagactttgcagcctccaatgtacttcttggtcactggattttcatgagataatgaccattcagtgaggaccatggcagagcggctctgtcttgtcagtgtcctgaattctagcctcgattactgccaaatagaagagtcacatgagcacattcctgtcctcaaactcacaacacttgcatccctcttattgccatttgattctgggagacactgactcccagagaagaggcatgaccgacccaacgagagcgggctgggaagtcttcaagccaaactaaagacatttctgagtcctccgatctgctgtttgaggtcaattcctcctgaagagcaggtgctgcctgacgctgacttgacctgcttgggagctctacaggggcagagaggtctgggctgcaggtgggacagtgagtagcacacctggtgagagccagggggctgagcacctgggtctcctcaccacaggcagccggctgcctccctggcttgctttcttcaactttctctgggggttggtctgtgggtttcttccagcaagggcagatcaggaggcctggagtcaccttggctgccatgggtccggtaacctgtggcaggaagccctggaacacacaggtctactgtgtgaccctaggtaaggcactttcctctctgggcctcagttttcccttctgcaacatgaaattgggctgaatgatctcaagatcacttcctttctgacaattttggattttgaaatctaagaccaggtgacagtgtggccaactgaaaaatactggccacatttcctagtttgctcaggctggctgcaatattgaccttaagctgaggagaattccacatggtaacttatgcctcaaattcctgttagaccttggtcaaagtgagcatccatctagtgatacctgctaatctttgtaaaaggcaaccctccccgtgggactgactgagaggtggactggcaaggtcaggcccacctactggcccaccatcctcttggcttctctgggggaagggctggggaaggatcctgtgctggcctgagctatagttgctgacaccaggcaacctgcaattgttggtggaagccctgccttttctgcagatgcttggctcacctataacattctaacctcactcaggtcagggtatcccacagcattgacctaccagcaatcagggggttctgtgcagagaaaactacccctgcccagggatccgcatgtatcccagcaagcagcccaggcctcctggacaccggcttctgccagtctaggccctggccaggtcctgacctgctgaccctctcttgggctgtcaccacctccacccctgtccccagccatgtcatcaatccccaaatctggttgtttctgtcccctgcctctcctttgggcttgggttcctacccctagttttgtcgagaccagaagttccaaagaccaacgacagaacagaaatgctggggaactttctccttcttttaaacgaaaattcttaaatgaaaaattacttgaaaaattttaaaccactgcagaattgtaccatccttggctctttcccctgaatctccctgtccccacatgcccctccccagagaagctacagttaatttaatatatgttcttcccgacgtcctaatgtatttatattgatctgcgacttgttttttttctttttttaaatctatgtatggatatctaggtttacctctttctttttgcgggcagcagcactgtattccatttttggctgtactcaaactcagccagtcccttactgatagatatgaaggttgtttccagctgtttctattccaagaaatgctacatagaatatcttctgcatacttgtatgagtatatcacaggctaacctcctagaagggagaatacttgattaaaggggatacaccttgaagcttttcatggggactggcaaatagctcttcaaaaagcagaaatttacacttccgccaatggcgggtgagcactatttccctaacctcctgcctatctggaatataaactgtctctttaacattagctaataagaaaggcaaaatggttgtatttggttcccattgctgctgtaagaaattaccacaaatttagtggcttaatgcaaaatttactatcttatagttcgagtggtcagacgtctgaaataggtctcactcggctaaaagcaaggtgtcagcagggccacttttctttctgggggccctagaggagaatccctttccttgcctttcccaacttctagagggtacctgaattccttggctcatggaaggctccccttccacctgcaaagctggtaacagccagccgcatctttctcataacaaatcattctaatattgactcctctctccctctcctaaggactcttgtgattacattgagtccacctggataatctctccacctcaagatccttaattaaatcacatctacaaattatcttttgccataatgggcaacatattcagtttccagggtttagaatgtggatagtttgggggtccattattttgcctaccacaaagatatcttacgtttcagttataattattttattattattttttgaaatggagtctcgctctgttgcccaggatggagtgcagtgacttgatctcagctcattccaacctctgcctcctgggttcatgcaattctcctgcctcagcctcctgagtagctgggattacaggcgtgcaccaccacacccagataattttcgtatttttagtagagatggggtttcaccatggcggccagactggtcttgaactcctgacctcaagtgatcccctgcctcagcctcccgaagtgctgggattacaggtgtgagccaccccgcctggccgatatcttatgttttaaaacctgtttcttgatctctagagaggcttagcatttttgcataaacatattcagttatttcatttgggagactatttttctggtttacataaactcttttgatattgaagctattgatcctttacatataggttgcagatatcttctctttatcattagtcttagctgtacagaatttttttttgtttccatgtggttaaatgtaccattaatttttccctttatgacttttaggtttcacatccaatattactttttagaatgtcacccaaattttcttctagttccattatgatttattttttccctcctttcctctcttctttcctttccattgtcaccttggctccatctggcacttatttgtgtgtaaggagtgaggtaaagataaagcttaagtttttttactccctagctagccagttgtcccaacagcattattgaatagtccacctccccacctctgaaatgtctgtggtgtctgataaaagcacaggttctagccctattccaaatccactgaaatagaatttgtgggaaagggacccagaatctatatttttgctaattccccatgtgaatattgtaaatctggcatatacttttctactggcatttggggaagctgatgaaattcctccaactgcctcctaatcaccttgcttccaggtttctagccttctcccagtccaccccactccactattcattgtggaaagagaaatctcttcagttgccaagctcaccagacctctccccttgtcagtaattctcagtagctccccaatgcagagagattcagccattggcgtttcagtcctgtcaaaatagggcccacccagtcttcctggcctcctctctctccatcctgctcttacactttgaactctctgcctttacacattgttgttcctggtgggacatgccgagaaaggagtctggagactaattccacagaggagtcagcatacccttgtttgagctgggttttgaactatgggaagatgttgatggtgagatttgcaagaaagagactctaggtgggaggcttgtgatgattaatatcgaatgtcaacttgattggattgaaggatgaagagggtgttgccaaaggagattaacatttgagtcagtggactgggaaaggcagacccaccctcaatctgggtgggcaccatctaatcagctgccagtgtgtccaggataaaagcaggtagaagaacatgaaaagactagactggcttagcctcctggcctacatctttctcctgcactggatgcttcctgccctcaaacattggacgccaagttcttcagctttgggactcagactggcttccttgcttgcagacggcctattgtgggacctcaccttgtgattgtgtgagtcaatactcctcaataaactcccctttatgtatacatctatcctagtagttctgtccctctagagaaccctgactaatacaaggttcaatgtacgcaaagcacagggggctggaatgtggccacaggaaatgtttcagggctccaggcaggagccccacgatgtgctgggatggcttctggacactgggaggtgtttccacacgtcccctcctaggccccagaatgacgagataaagtcccaaactgtgaagcctcattatgtcaagcagatcttctaacagagctgtggtcagtgactgccctctgaaagcaggtggaaggcacaactgggtccccatggggtgggcaagggcgcactgctgctgctgggctgggccatgcttccagggtgaccagcccctcataccctctgacctggattcattcatggaaaacaggcacaacctagagtccatagatagcctgtgttggaaggaagaggttttttgctaatccaatgggtcaaacagtgctgttcccccaagaagcctgggatgtctgccttgagccaggcctgtggcttaaccagttcatcagtgtcttccaggtgaacctgcctccccctggcctgggcaggaactaggctccattcagatttgcatttccagtgcctgatacagaactccacactcagtaaaatattaaaaatatttaaaaacacttaactgaccacctaccatgcccaaacaaaacaaacatattgattcttacacatcccctttttatagatgggggcagggctgaggctaattgcttcagatcagacacaaaaaggcaaaggcaggatttgaaccctgagtgctggccaacatccaggaaacccccaagggccctgatcttggtcagaatgaccgagtggatcctaccttccttccctgtatctgagatcctccaggaagtcttccctggttaactgcagccacctacatacacttgcatcaaagtcctccctgcatgcaagtcactctgcatgaccatgttaaccttagggctgagtttcttgttaactgctttttccctcaataatgaatggtggatttttcactgtctgggaggctcttaaatcatttcccttggatgactggtctctgtgttcctacttttccttctcctcctccctcccaactccaagacctaaacagggcttggaatttctgcacactggtcaaaaagcaaattctatcgaaagcaaacagaagcctaggcaatcctagacgagttagacccggctggtatttgtcttcctgttagagagctcagggatccaggtgaaactgatatcaccaaggagaatgaagtctcctgtgacatccccatagaaagcaaaaacacatttcacagtcaagatcaagcaatgatgtagcaaaaactctactctgccagacttgcagaggcccagatttcccctgattgtctgtgggcataataattcagaggaagatcatctaaaccaatgtcctgtgcctagacggagcaaatgaactctgactatgtgccagggctgttcttagtatgttacgcaaattcactcatttattcctcacaatgacccttcaggcgggtactattatcattcccattttacaggtgaggaaactgaggcccaaaatcacaaaactgataagtagcagagacagaacctgaacttggaccatcaggtgactcctgcagtggtgaccctcaaggcagccaggccacaccagcctcacagagaggacacagatttgaatcacagtcctgacactgcaggtaaccaaacactgtttttagcagccttcctttccttcataagggctaagcttgttaacctttttttacctttctcctggaaaagtatcgacagtgtttaagccttgcttccattgagaccaaaaatgaactgacattagctgctacagccttacctcacctacacacatctacaaacaaggcccagatgcttgtagctaattcacctactaagttatctaatgtaatgtacatagctagctatccacctacctatctcattgtttatttatatccgatttttcccatgaggattaaaagaggcatctggacacccatgagaactcagtgggcatctatgaacttaactcaacctgtttatcttaaatggtccaggaagtgcttgtgggtgaaagagcttagggaagaacaaagcctgaaatgagagttgcgcaggcccagcaggcttgtcttctggccatttgtgtccagccagtctctcatcaacaccgcctaagagagacccaaattccacatttgctgcagtggcctgatctcttgtcagtttctggcaggtctctagtggttcctttgatggcattttgtttctatacacgtgactgtggcacaaaaggcacacctacctacaagcttcctaggtagttaaggttcttgtgtctactatggagagcaatacatagaatacacaataatatatacacacacacactataagatgaaccacagaagaaaaaatgactgggagactgggtgacatacagagtgtagtccaacagaagaggtggcgactgcctgtggcttctgtcattcttgcccacatggcaggatagatataactgtatagtaatgataaagcagttataacgatcactctactgcaactcatttcttcatttctccactcagtctgcaagtactacgtgggccttctcaatgccaggccagtaagatgaaaacagacataaatcataggccttactataagctacagtaatcaagacagtatagtatcgatacaaagagacacaagaagatcaatggaaacagagtagggtaaggaaacatactcccacacatacagtcacatgatgttatttatttatttatttatttatttagggacaggatctcattctgttgcccaaactggagtgtaatggcacaatttcagctcactgcaacctccacctcctgggctcaggtgattctcccacctcagcctcccaagcagctgggactacagacacgtgccaccatgctcggctaatttttatatctttttttagagatggggtttcaccatgttggccaagctggtcttgaactcctgggctcaagtgatccacccaccttggcctcccaaagtgttagaattacaagtgtgagccaccacacccagtctcagtcacctgatttacaagaaaaatgcatctgatagagaaagtaatggtcttttcaataaatggcgctaaagctattggatatccatattaaaaaatgaaccttgacccccgatatcataccatacacagaaaacgaatgtgaaatgaataaatgataggcctgaatacaaaagattaaacaataaagcttgtagaagaaaacaagaaaatatcttcacggaacttggggtaggcaaagatttcttactcgattgacaaacgcgtaatcacataatcataaaggagagaagctaaattgtgcttcattaaaatttaaaacttctgttcaacaaagactctaataatagagtagaaagacaaaccatgggttgggagaggatatttgcaacacatgtttgaaaacaaattcctaaaaatgagtaagaaaaaggcagtcaacgcacctgaaaatggcaaaagttaactcaaaatgaatcaaagacctaaactcagagataaaactatagaactcttagaaaacataaggaagaagcttcatcacattggatttggcagtaacttcttagatgtggcaccaaaagcatacacaacaaaagtacaaatagataaattgcctacatcaaaatttaaaatcttctatgcgtgaaaggacaacatcaacagagtaaaaagacaagaatgagagaaaacgcttgcaaatcatatatctgataagggattaacatgcagaactccaaaactcaacaacaaaaagccaagcaaaacgatttttaaaaaaatgagcaaaggacttgaagagacgtttctccaaagaagatctacaaatggccaagaagcacgtgaaaagatgctcaccattaccaattactagggaaatgaaaaatcaaaaccacgaagataccacctcacacacattaaaatggctacaacaaaaaaaagaaaaagaagtatttgcaaggatgtagagaaagtgagtggaactgttgcactctgctggtaggaatgtaaaacggtgcagcctctatggaaaacactgtggtagttcctcaaaaaataaaaaatagaattaccatctaatccagcaattccccttctgggtatatactcaaaagaattgaaatcagagtctcaaagagatatgtgtacatctatgttcatagcggcatgatttacaacagccaaaggtggaagcaatccaaatgtccattgatgaatgaatggataaaaaattcattcatgttgtagcatgtgtcagaatttccttctttaagacggaataatattccattgtgtgtatgaaacttgatgacattatgctaagtaagataagccagccacaaatgaacaaatactgcataatttcacttatatgaagtacttagagtaatcaaattcatagagacagaaagtcaactggtggttgccagaggctgtgggaatggggggctgttgttttatgggtatacagtttcagcttttcagaatgaaaagtaatctagagattggttgcgcagcaatgtgactgcttaacactactgaatttaaaatagtaaagttggtcaatgttatgtctattttaccacaatttttaaaatagcaaaagattttaacaggcactacaagcaagaggttatctaaatggtcaataagaatatgtcatgaagttttcccctatgttttcttctagaagttttatgtcataaagttttctcctatgttttcttctaggagttttacagtcttaggttttacatccaagtctttaatccattttgagttgatctttatgtacggtgatttttatgtatggttaatttttatgtaagataagaatccaatttcattcttttgcatatgaatatccagttttcccagcaccatttattgaagagactacccttcctccattgtgttttcttggcacccgtgttgaagatcagtcagcatatatactggatttatttcgggttctctgttctgtttcattggtctacatgtctgtctttatgtcagtaccatactgttttgattagtgtaattttttatgctttgaaattaggaaatgtgaggcttccagctttgttcttgtgtcagaggattgatttggctatttgtgttttttgtggttccatataaatcacagaattgttttttctatttaggcaaagtaatgtaattgagatttttatgggggtttcattgactctgtagattgttttgggtagtatggacatgttaacaatattaattcttccaatccatgaacacaggatgtctttctctttgtttgtgtcttctttaatttctttattaaatgttttgtagtttccagtacacaagtctttcatttccttagctaagttcattcctaagtattgttttaggtgttattataagtgacattatttttctaattttcttttcagctagtttgttgttagtgtatagaaatgccactgatttttgtaaatgattttgtatcctgcaactttactaaatttgttaattagttctaatactttttaatggcatctttaggattttatattattttgtctgcaaacaggaacaattttacttcttcctttctgatttaaatgtctttaattttttttcttgcctaattgctctggctaggacttccagtactgtcttgaatagaaatggcaagcaagggcattcttgcccttagcttcttcctgattttagagaaaaaacttttccgtttttcaccactgagtatagtattagctgtaagcttgttatatatggcttttattatgttgaagtactttccctctagtcttagttttttgagaactttgatcaaaaagggtgtgttgaattttgtcaaatgccttttctgcatctgttgagatgctcatgtgattttaagtctttattctgataatgtgatgtataacattaattaacttttgtatattgaaccatctttgtatcccagggataaatcccacttggtcatggtgtatgatccctttaatgcactatttggtttgatgtgctagtattttgttgaggatttttgcatctatattcattaagaatattagcctgtagttttcttttcttgtggtgtctttgtttagcttttgtatcagagtaatgctagcctcataaaatgagtttggaggtgttccctcctcttcaattttttttggaagattttcagaaggatcaatgttaaatctttaaaaaatattttggtagaattcaccagtgaagctatctggtcctgggcttttccttgttgggagttttttgattactgactcaatcttcatattagttataggtctgtttagactttatatttcttcataatttagtcttgtatttttctgggaacatatccatttcttttaagttatccagcttgttggcatagaattgttcatagtagtctcttatcctttttatttctgtggcatcagttgtgatgtctcttctttaatttataattttatttatttgagtctcctctctttttttctagcatagctaatgatttgtcaatttaaaaaatcttttcaaaaaaccaactcttagtttcattgatttttttcctattgtttttgtattgtttatttcttctgtaatccttatatctttccttctgttaaccttggccttaatttctttttctaggtctttgaggtataaagttaggttgcttatttgagatccttcttctattttaatgtaggcatttatcacaacgaactctctgagtacaggttttgctgaatcctataagttttggtatgttgtgtttttgttttcatttctcttgaggtattttctaatttcttttttgatttcttctttgacccaatggttgtttacagtgtgtcatttaatttccacatatttttgaattttcaatttccttctgctgttgatttccatttctatttatttatttatttttattttttattttttgagactgagtctcgccctgtcacccaggctgcagtgtagcggcgcgatctctgctcactgcaacctccacctcccgggttcaagcaattctcctgccccagcctcctgaatagctgggattacaggcacgcactgtcatgctcagctacttttttgtatctttagtagcgatgtggtttcaccatgttggccaggctggtctcgaactgctgacctcaggtgatccacccacctcggcctcccaaagcgctgggattacagtcgtgagccaccgtgcctggcctatttatttttttagatggagtctcactgtcacccaggctggagagcagtggtgtgatctcagctcactgcaacctctgcctaccaggttcaagcgattctcctgcctcagcctcctcagcagctgggattacaggcacctgccaccatgcccatctaatttttgtatttttagtggaaacggggtttcaccatgttggccaagctggtcttgaactcctgacctcaagtgatccatccaccttggcctcccaaagtgctgggattacaggtgtgagccactgtgcctggcctgctattgatttctagtttcatcccattgtgatcagaatatatatttggtatgctttcaatcttaaatttgttaagacttgtgttgtaacttaacatggagaaaaatccatgtgtgcttgaaaagaatgtgtattctgctgctatttggtggaattttttggcatttatttgttaggtccatttggtctatagtgttgttcgagtcatttgcttctctgttgatcttctgtgttgatattctatccgttattaaaagtgaggtattgaagcatataaaacaatgctcaatacaattttgtcattagggaaatgttaattaaatctacaacacattcaccataacagctaacatgaagcaaacaaaatgacgccaagtgttggcaaggatgtggtacaactggaactcttcttgtgcattgttagtgggaaggtaaatagacacatttggacaattgattggcaaagactaatgccacacacctaccctcagacccagaaattccactcctaagactatatcctatagaaatgcctatgtatgtcctccaaaaaacacaaagaagaattttcatagcagatctattcatgatagccaaaaaaactggaaacagctcaaatgccagcaacaaatagaatggataaataaattgtggtatattcatataacaattatacatagtaataaaaaagaacaaagtactgctacagacaaaaatatatatcttacagatataataataagtaaaggaattcagacacaatagactatatgccgtgtgatgatgtgaatgtggaaactccacaattcaggtattgtcaacgtgatagtattaagaggtgattaggctgtgaagattcctccctagtgaatgggattaggtgtctcataaaagtgcttgctgaggagacttcatctcacttgccctggtacctctcaccatgtaagaatgcagcaagaaggccctcaccagacaccatatgtcagcaccctgatcttagacttcccaggctccagaactgtgagaaataaatttctttactttatagattacccagctttagtattctgtactagcagcctaagacatactatatgattccacttaattaaagttaaaggataggcgaaaaaccaatcttatggtattagaaaataggatagcccaggcacagtggctcatgcctataatctcagcattttgggaggccgaggtgagtgaactgcttgagcccaggaattcgagaccagcttgggcaatgtagggagacctcatctctacaaaaaataaataaaattagctgagtgtggtggtgcacacctgtggtcctagctacttgggaggtggaggtgggaggatcgcttgatcccaggaggtagaggctgtagtgagctgagatcacgccacagcactccagtctgggtgacagaatgagactctgtctccaataaaaaaaaaaaaaaagagaaagggaagggaagggaagggaagcggaggggtggagaggggaggggaggggaggggagggaagggaagggaagggaggaaaggaaggaaaggaaggaagaaagaaaagaaatcaggatagtggtttctgatttctaatggggcaggtgggtatttactccgaaggggcatgaagcagttttctgggtgtacaattgttccacatcttgatgtggttacatagatattacatacacacacgcacacgcgcacacacacacacacacacacacacacacacatacatatgttaaaaagaaaactattccagtacagcggtacacttctggtttgtgtacataactgtatgtatgttatacctcaatttttgaaaagacatgggctttacacctgaaaaatacaaagcttatagggaaagagaaaaaagaaccaaaaagataataaggggtggtagatgccatgatagaaacaggttcccagtacaggttgggagaggctgactcctgggggtggggagggacggctcaccagcgtaggctttagagatacacacactgggctctgaaggatgaacaggatctcaccgagcagaaaaggggatgagtgggagaaagacagaaagatgctggggaaaccctaattgtgtgagaaggtccagtgtggttagagtgttgggtgtgcagagcatagtagtggggggtggggctgagggcatgaatcaaatcagctttcagatttgtttatttaaataaattccccataaacattttttgagtgaacaaatgaaccttctcacggtcatgatacatctgatgtctggaatggtaggacagatgtgttaggatggcagcaagtactgaatgaagagatgtagtactggtgtggttacaaagtccatttcttctcaaattattaatctctctaaaatctgatgtcttctaggccccagaatgccaaaccgtcctcacttggttatggtactgactctctgctgtgaaactgcagagtttttcgcattcaacctctctctcccaatttccttccaccccatctcacaatttttggtggttaccaatttttggtggttctggcagttgcttttagcatcttcaagtaatatacttaaattgcgattttctgatctatcaactttagacagtgtctattcacttcctactatgagcaataaaatttgtccacattctctactttccacttccttccctcctgcccaccttcagatttttgttatatgttattgcttttgcataacaattacattctcatcgacagtataattaagtctactctataggataattctaaaaagtgaagctagttaacaacatcattatgaagatatcattgcctgcgaagccactcagtatgaatggacccatgagaaaggcaagtggttccacgttactgaaacttggtcacaagaagaaaaatggatagcttccttcacttcttcttgaacctcatttaataattattttgggttccttttttgattgatgaaataactccaggaggttttattttcttccagaaaatataggtgactgagtgacaaactttctgaatcttacacatttaaaaaactatttttttcaaagtttgacaggatgactcttagtttatcctccagaattgtgaaagtactccactgtactggagcatcttgcatgactggtgagaaattctgaggtaatttttgagtctctctggaagttttttgttttttatccttgatgttctgaaatttcaccaagatgggtctgcatgctcattttactaattcctgccctaaagtcagtatgatctttctagtttaaaatctgtgtgtgtttcttttttttttatttttatttttaaattgaaatggggtctcaccatattgctcagtgtggtcttgaactcctgggcttaggcaatcctcccacctcagcctctcaaagtgctggattataggtgtgagccaccaagcctggccgtgtgtatttctcaactgagaggaaatttctttggctatatctttcactatttctacccaccccctgactgtctgtggcttctagttctagatctcctagttgatggatactgaacctctggatctatcctccatgggtcttaatgttttcttcttgagactttgctctgctttctgggaggttttcttggttttaacattgaaatgaccaatctggtcttcatgcatatccattgtgttattcagtttttccactgaagttttttccataatgatattttacaatttcagcaagtatttcctttcctccaattgtgctatcttcatagcaacctgctcctctgatattataggttatttcacttacagaggtgaatgaaagaacctcttacttactgttaaggatactactgataatttagttttgggctttcttatattcaaactgtttcctttgaaataagctcttccttttttttttcttttttccattttaggccttctctttcattctattggtttgcttccaatgtttggtgattttggttatccaatatatttatgaatgagggattatgttgtaaagttaggatatgtattaggatacaggttctagctcctataacaaggacctaactgcaggagtggcttagacgagacagtttatttctgtcttatgtgcaatctgagtttaagtggccatggctgatatggtggcttcaccgtgtggacatctttgatcttggtcttctgatatccacagcacatgacttccatctcccaccatcacatccacaccctactcagtgggaacgataaaggggagggcagagctgggagttgcacttgtcatttcagctcacacgagcccatggccactcctagctgctaggagggtgaggcagtgtagtgtttagctgagtggctgtgtgccctgctaaaatttccatcactacagaagaagagaaaaaagatataagtggaatactaactacatagggcttcccgtgaggtgtctcgtctatttctctgaccagttcagtcttgaatgtgagggtggcagtcatggaaaggttccctgcaggagggtgaagcagtgtggcaagtctcctagtaataaccgtggacaggaagtggccagggaactcccacaattgccaaaagaaggacttttctccatggtgggcataatgctatacttcaccctgagacggagctgccaatccttcttctggctccctgccccacatccagtctgctagagaggtctggaatgcccttgctcagctgctgtctcagactttccttagagagcatttgttggggaatttggcggccactggctgcctgcctctttgtgaagaaggcggggaggggtccaactgtacttgctcttctgaagggctctcaggggagaacactgctaacccattccttttctgtgctttgttggctctcagcttgaactatgcttggctcttctgagacaaaaatcactgagacttctggaatcctgggctgcaatgttttctgctctgattgctctgtctgtgcaatctcatgggctttctatcttcctaagatttaggaatgtttccgtcccacggatgacttcctatcttgttttctaatgctgttatgatgtcatcctttcaaaaatggctttcagctgggcacggtggctcacacctgtaatcccagcactttgggaggccaaggcgggtggatcacttgaggtcaggagtttgggaccagcctgaccacatggtgaaaccctgtctctactaaaaataccaaaaaaaaaaaaaaaaaatagccaggtgtggtggtgcatgcctgtaatcccagttacttggaaggttgaggcaggagaatcccttgaacctaggaggtggaggttgcagtgagcctgggcaacaagagtgaaactccgtctcaataaaaaaaaaaaacggttttcactgtcatcataccaattcctagggaagaggtggaggtgggcacttgtgctccaggacttaggaaatcaatgcattcatgactcattggctgaggccaatgtcccttccaggatgtggacaccggaaaggaagatgaacccttcccatgcagggcatcatctcagaactccatggtgtctgcccttagggggaacacttctgatgttcctgaacctgggcccccaccgatgcacaatgcccacctagttccactgagggtaggaacagccagccctgtttgcctgggcagcctagtagttcatggacaccagtcaatgacccgactgcctaagggcgtgcaagcctccgtgtaggcacctggcaggctgtgtttgcctttggaggtggataatcagcaaagtccctgtacactgtcagctaccacagctgagattcagcgagctatctacactaagtgtaccaggagaaagggttccaccccatcctctaaggttgctcaaaggctgtctccaatccataatgacacccctttttaagacccttcagcctccccactagtttaggccccacggcatggctctggaggcctcacctctctcattccctccatctgtgtgttccagccacatggagctggagaattctcagaacacacgccgttcccaatggctgaaatgccctttccctcctagacatgtggcaaactcctcaatgtcctttaaacccaccagtgatggttaattttgtgtcaagttggctatgccataggccaagacgcttggtcaaacattattctagatgtttctgtgaaggcattttttagacaagattaacatttgaattggtaaactctgagtaaagcagaccgctttccacaatatgagtgagcctcatccactcggttgaacgccttaacagaaaaagagtgccctccccagaggacaggggaatgatgtctgcagactacctttagccttggctcctccttcctggatctccagcctgctggcccatcctgcagattttggacttgaaaagcctccacaactgcatgagccaattccttaaaatctctctctctgtatacacacacacaccacacacatacacaattggttctgtttctctggagaaccctaatacacaacttcagacatcaaatccttcagcgagctttctatggcccccttacactcagccagtcacctctgtaccttagacactttgctgctatcacatgtcttacaccttgtggtaatgtatttgtttacaagcttttctcctcctacaggacagggttcttttaggccaaggagccagtctcattcaccattacatccctaggtgggtgaatttgtgagaacaagagagtactgaggctgatggcctaggggaatcctactggatggtgggaggggcattcccattgagcctcttgaaaggcatctggtaagacaggccagagagggacggttcctgcaaagcaggctaacagcactgctcctgaatatcagtcactggtggggcagtggcccacagccttcttcagctctggtgaggagaggaccccacaggccatggtaccacctgtccagcttctccagctccacccagggagcccggtttaattcaataaatacttactgaattccgagcgcaatttcttgtgaggcattcgcactctaggtcctgatctgacctccagatcttccttttttgacaacatctgagctctcaaaagcactcagggaatgtactgtttgtgtgcctgaggggagcagtcatcatcctcagccttcttaaacttgccctgagaccccccaagctcccactctgtgctccctgaacaagacgatgttgtcaagtatgatttcgtggggctgcatttccaaaaaataagctcttgcagttcatacaggctttcttccattcaaccaggtgaactctgaaaatcccacactgtgagaaagaaggccgtaggctcagggtgtgggggcagaagggtgaccctttgagaaaattactagtgtatgttacactcctgttctaaacaaaggtcacgggttgtccagggaattatgagcaaatgaatgagtgaatggatgaataaacaaacgctaagttgaatggatgataacgtaacccaggctcaagtcaagagcatttaattgaggaaacaggagaagagccagaagataagctatacacgggcaaagggacttccttaaaccaaaggtggtttaaggaaggcaaattccatctcgtaacaaagacacaaactgtggagcaactgggataatcaatcataagaaatgctgatggggacagagcgccatgtgccaggctctctgccgagaacctgacatgtcctcagtcctcagaacgagcctatcaggccggcaatgtttttacatccatctcacagatgaggacacaaaggcaccgaaggttccatcatgcgcccaggggcacacattcaacaaagagtgagactgcaagccaaggcaggcagggggtctgcagtgtgtgtctcaaccacttccccatttcacctccacatgtggctctagcagcctttaatcaaggaagcaagggaaaactcgaatgttgttcaggcctggggatctagagacccacctggctttctcccactgtcctgggcaaccaggcaagtcctctgtgagattgtgctgcctgattccatatcggaaaaatatggtattcactagagttgggtttcggggacctttcccgccctgacattctggatgcttctccctagcctgggaactccggttgcctgaggtcggctcaccccagagcacctgattctggccccagatgaacctcctgactaggtctgtgaagatataaactcgcccttcttgatggcccaggctttttctacaggacccaacctcacctcaccttcctgcctggcagtctggctattccaccctgtgatcccacctccactcctcccgcctccccaccttcctcctcccactcccacccacctgtgccccagctcctctcaccctttctgcctcctgccagggttcaagcccctcccttggcctgctgcccggtcccccatcttcccttctttgttcagccaaatccttcttgtcaccactgccagtttctccctgggacctctttccatctcagacagaacccattctgccttcccctggccggtgtttacacccctgtttcagatggatcataatcccaacaatgccgccttacgttagtgcagtgactacagctcaccaaaggcccctgtagccactgtctcatttaatttcacccaagttcctccttgcagacctcctgttcatggctccaactgccccctaagactgcaaacacaatgtctaacatacttcataactaagaatttcctcaaaacagccctctgggaaggggcttatcacttcgttttgcagatgaggaaacagaggttcagagaggtggaaagtggctgggctggatccacagctcaggactctgattctccgtcccatggttctcaaggattcatggtgttccctgagtcctgcctaggatcagactcatttctgtattcctgagctatcctttgcttggacaaatacggtatcctgaactcaggggaccaggagggtttgctggcttaaaaaatgaattcatcagggcctagaatcatcaccgtcctaagtgcctccttcagggtaccacagtgccagcccctgtcccctcccttcatctttgcatggaagagatgggcagagctgggccctttagggtctgaggtacaactgaagcctcagaagaaccgataaaccatgtttcttgtttgccacacagaaatggggcagtctctgcctctcattgtcccaacctggccctggcagggtgaatgcagcacctccttccaggaagcgcccaaggaagctccaagggacctggacagggcagaggattccctgggcagggagcagtggaggacagccaggagcactgggcgcggagtcagccgctaggggctcactgcctgcagggacactccctccattcccaagagctccaaacccttctgacaagctgcgtcctctccaaatgggtttcccaataggctttggcctgagtgaatgatttctttccagaacaggaacacacccctgccttccagcccaggccactcacagctcccctctccagaggcaatgacagttgtcaattcttgactgcttactttggaacgcgtggggcgggtctcgtgacattttatattgtattccctcactgtactaatcttttcacatgcccatctccccagctacacattttggagagcaggggctgtattttaaacaccttcatgttctctgtgcctgccacatagtaggcactcatgggtatttgtgagtgaataaataaataaatgaatgaacaaagttaaaattgtggaaagcttcagttaatagtttgcagaagtcactttaattccttctgaaaaaaggggtgtattaatttgctaatgagtagaattgtgtaaactttgagtatctttctcataaacataactctttaaatgctgtctagtcatttgattattcaaatattgagatacaattcacataccataaaattcacagggttgtgcaaccatcccaatgatgtaattccagaacacatgtatcactctgaaaagaaatcctgtacccattagcaatcactccacattcccttccctccagcccctggcagccactaattcatctagtttccatctctataaatttgccttatctggacatttcataaaaatggaatcacccgccatatgtccttttgtgtctggcttctttcacttagcataacgtttttcatcatttgcactaaaaatatcagtgtttcctggtgtttctcacagcaccctgacgcccaggccacaatgcctgtgagatcacgcaggttggagctggccgctctgagccatcagggcagtgtggcgtccggcagcagatgtctgtgactgggcagtgcagggactcagatgggagaggtagccacaacatgggcagtctgaggtcagcagcagaatcagaatggtcagaaacagatagcacatgggacggcactcaatattcctccccaaggaacagctgcctgaaaatataattatctggtggtgagagaggcgtgtcaagggccaccagccctgagtctaaaggctctgagtctgcagggagagtaccatttctgagatgatctcaaagctcaacagagggtgcaagtcccaagggcttagatggttccattctaggggtggaaaacaggcagtggccatcccaactgctttgccaccctttctgcctaaggcaagcctcctttctgcagggcttcagttcctcgtaggaagtcccaacaggctgagcagagccaagcatgctttggtcatgtacagtttgtgcacagatagattaactcattagttaatcccctttttgtctttttgcaattttaacttgatttattccacagtagatttgaggtaatttacaaaaacaaaataggaacacaaatttaaaatgaaaaatcaacccaggggaaatgaaagaccagaagggatggaagaagatgggtaagtcacttagaaggccccacatggtagctctcttggggccatggatttagtatacagcagtcagaggaagaagggcaacacagttagctgcacagtctccgtgttctgatgatacgctggccagttcctcagaaaaaacaaagctcttcttggcactaagatctgaaggaaatttcttccatgctgttttaagtagggagccctccatgaagtcatcctcccaatacttccggggctctgacatccagctctgagctaggcaattggctctcccagcatctcagaaggccaggtgggccccaccctttaagtcattagctcctgtttgggaaacgttgtgccatttggtgaccaccgttacaagttttctcagaaataatgccatcgtattgtattgctatttatgtaatagtttaatttactttgacttgaattggacttgtttaaaggttacttcttcctaagcaatagggaccacaggagaaactgccaactagtattttttactgaattaaataaataattttaccagtcaattaaagaacttccagcatgttctcccaaaatcagctcatcttctactcatggtttatgtcctgaacttgggaaatcggcccgtccctcaccttgggatgcactggggctgccccccatctcctccacctggagaaccctcagcctggcttccccatcacaccacgcaagcttagagctagagggcacttaagtggggtctaaagtccacgtttgacaggtgaagatgctgggcccaaggaagagaagggattcgcgcaagaccacaaggccagtgacaggacaggcaccaagactgcccagaaacagtggcagggccggtggacatttagatgtaaccaaaggctgaaactcaccaaaagagtctaacaggaaaagactgtgggcagagaggcacagggcctcacccaactcagggcaagcccggtgggggcagggtaaacccagaaaacaatcatgggatggtaatcccgagttcaggatgacggtcactcctgggagcacaggagaaagggacccacattgtggaagcgatgcagggcttccactgtatttgacaagtcttttttttttttttttttttttttttttttagcagggtggtgagttcactagtgttatattatcatgcataatattgctgcttggatgaaatattttgaaaatattttatatttgttaaatatattaataactccaagactcctttaacaagtgtgttttctctctgctaagatgacactctctaccgcatctcaagtggtttaaccaaaggggagaagaaatgactgatttccacaagagacatgccccaggtggggagcttctgtcacctctccctccactcccaaagcctgtgacatgtggtgggtggatctgagcatcattgtacctgaccaaggtggagtccatttcagacaggtcatggtgtcatggttggcatggctcatacaaacccatgggtctaggaggaaacttagagcaccccaagtggaaccatgtgggctccactgatgaatgccacagcagggcaatgggcagtgctgtagaattaagcccccagccaacatctttgttccccacctgcacaaaggacgtgtcttggcatgtatatttttgcaaacagcagactatcccgttcagttaaaggcagggtaggatgtactttgagatttctaagagggacgcacagagtctcagagtctccgggttgaagggactgccaaggacactgacccaagctcccatttgagactccagccttccttagaggctgctctcaggaggccactcactgcctgaggcaatagcaattactttttttttttttttcaaacagggtataggaagtggggaagatggggagccttttttttttttttttgagatggagtctcactatgttgcccaggctggtctcaaattcctggcctcaaatgatcctcccgccttagcatcttgagtatctcagattacaggcttgtgctactgcacctgctcaatttttgtttttctaaaaatggtatcatcctatgtacattcctcagcactcggccttcctcatggacagtctttctaggctacaggccaataggttgtgagcagttatcctgtaccaggcacagttataagcacctcacataattaactcagttactgctcctaacaagcttaaaggacaggcactattgcaatccctactttaccaaagaggagtgtgaatggccagagggtcaagcaacacagtttgtaagtggtgggatccggatttgaaccctggctgtctgtcttcagaccctgtgctcctaaccactctaccgtactgcctttccaaacagagacaggatctgtctcaatcttgttacagctgaatgatggaccatggtttggatggaatacctttaaatttactgttaagtttgtatattttttgtaagttttcctactagaattttgccataaacatcctttatacacatatctttacagactgatgcattcattgttccataggccggatttccagaagtggaaacatggatcaatgtgtgtgtttttggttaaaatacctatggggcctattgtttgggccatcgtcctaataatgagccatgtcattttcactcactggttttgattctgtcccgaggaccacacagaacatctctgaccctttttctccagacaacccctggggtggttgaggacagcaagtctgtctctcaagtattctgttacccagtttcttcaaaagttcctctgacaagggctgcatgctcctgagggctggtccagatacctcttaaagtgcggcaccgcctggggtgatctggcttatgccccttgctccccattcaaagacacacagagagggacattgacagtgcacaggagatatcaacagtgtttcctgacatccatgatgcacgggagagaaccaagtaggtaggattcagacttctcatcttcacctctcccaaatcacacacatgccttcctgagaaagagaccctttgtgagatattaaagaccagccaaattctactcccacatcataagaaactggagttcactctttaattagagaagatgccaatggctttggaactggacaggcttctaagcatcttttagttcagtgtcttcttttacaaaagagccctggagggcaatgaccgcaccaggctcacatgtcattgggtgtgtggcagcatttccctaagctgagaccagggtcactggtgggtgcatttccccagctctctctgcctgctggttcctaggaaccatcttactagaaaggcgtagtgtaaatattttgctaagcagccaagagaggaaacttacccaggctgagctgccctgtgctgggtgctggccatggacacaatgctcaatgagggccattatctgggaagggagggctgtttgttccgctgcgggatggtgccagagcccggagccaccaggcttgccactctggctgccacacagaagagtctccttgcgctcagcagactctgcggttatgcaatgccgggccaggaggttaactctccccaggccaggagccaagccttgttccttcctgcctaagcatgtccatctgaaaatgctgaaaattgagggcctcagtgtttgcaaaatgtgctcgggccctgaacctgctggtttattccaaagggcgtagtgttgaggagctggtgtgcccatccttgtggctcctggcagcctcctaccgaggcccagtgctctgacagcagcgtctgcctgccatcctcgggcaccactcataggccttgcaaccctttgcctgggtgcccctgtcccgttctttccctttcggtggtgtctggtctaagtcctttcttaagcccgagttctactcacttgttcaaagccttccctgaccaccccaggccccagtgacctgagctcaaggatgagtttcccaagacaaaagggaccttggaagttatctatccacctggcccattttccagatgaggaaactgaggcttgaagaagttgactagtctgagagaagactgaacagatgtgtcagcctggctcccctctcagaactctttctcttatacctcacgtcccatctgtcagcaaatcatgttggcttgacctcaaaatggagctggaatcagaccccttcccatggcccccgcagttgccaccctggtgtgtgactctatcacctcctgatctgtcacatcactgcctcctagctggcctcgggctgctgcccccgccccctccagggcagcctccacagcctccttcggcaggacagcccactcctctgctcaggcctcccagggcttctggatgttgtgcctgcctctcccttccagcctcctctgctcctgtgcccccacccccactcctccagccacaccagcttccttgctgttcccagcaggctgatcttgcctccgcctggaatactcttttctgatacccccagcacttgctcctcgcctccctcaggtctttactctccacccgtcctgactgcctgatttcaaaaccttgacaacctgccagccccgtgccccctattcctttcctgactgccaccttgtcacatactatgtatgttacttaagaagataatatatttacatttattttacatacacttatgtttttaagatctcacaaaatatacagtctatagagagtgtgcatgtgtgtgtagtgacgatatgtttgtctatttccctaccagaatgtaactccaagaggcaggtgttttgtgctttgtcacccagaatggtgcttggccccttatgtctaagtagggccgaaggtaaggatgacctacctctttgaggatggatgaggatggtgatggtggctggggtgtcacctgactggtatgggtgttaggagtgggggaagggatgagtttggtggcatatgtaggctcagcagagggagagccagggctccagggaggtcagctgggaggctgtccgaatgctatatttttggagccatatggaataaacacccagacacctgggcctcagtcccccaaccccaaccagccccggtagagcagctccaaaataggaaattcgcagaggtagccccagagaggctgctcagattaggctgcagtgagcacctaggcatggctggccactccctgcttttaggcatcctgaatttgcacgtctaggaatctccatctccatgtttcaagctctctagtgggtgactcacaggctctgcaggggtttgggggctgcagctgagttcctttgaatatctgttgaatgaataaaagaaatggaaggaaagggggaaaggtgctaaggcagacacaggagaagaggacaaaggcttgggagcactgaaacgaccccagggaggcatgccaaacagagcccgaacagaggcaagacagcagggcttgtcctgacaggtggcacaggtgggtccagtttccactcgctttcccacacctgcagctacgctggccaggagcacaaacctcaagcaaacagaaattttttctcgtgatttcagttttagtttgattgacatttttatttacccatgacatagtttcttttaggatagctggctttattctaaagagcagcccaaactaagtggcctaggtgatttggctgttcaaatctcccttttctgatcctcctgtcctgccctacctctcctctcacctgtctgagcacttctctgactcttccatccaagctttttcttcctagatgcctgtactcagtcctcaagctttggtctctaatcccctgcttttctctctctgcactgctcaccttgacttggtagcagcttccacagctgcacacatcacctgccccacccagcacgccccaatcctgcatttccagcagctctcacattcaatatgcttagtgccccactcatcttttcacccctctgtctctggtaaaccttcaggcttgcgacactagtgctacctctaaactccactctcctttgtcctcatagcacccattcacccagtcactcaccctccactcctaccctttccttcaagcaaacagaaaccctgattggttcaacaattactgatcaaccactactgtgcaccaggcagtgctgggtaccggaggcatttgccttggcctgttcttcttccacctgcggcacctcgaggaccacccgaggccctgagattgggagaggaagcctgttccataactggtcagccccacacctgcaagtaattgacagtgtgaccctgggcaagtcacttgccacgtttgagcttgggtgttcccaattgccctttgggaggattattcattcccgcctcacctgtccccagtccagctgggaaaggcatcacccggcttcctacaggtgacaccagtctgaataatacttgtggtgcacccatagccatggtgcagcctcttcctcccacagaccacggccttgacccccttcagcctcctggcccccagtatgggacagagccctggaatctgcattttaaagaaactcaaggtaattctgttatgggagggtatgtggacacacatggagaaattctggctcacaggataaagtctaagcttcctcaccacccccaactcattgatgaaaacttcgccctgctttccagcattggccccctctgtctcccaagggagggcctgcagccgtggccagactgctctgtccactccccaccctgagctcagcaatgagcctgctcttcttcttcttttgttttgttttgtttttcgagacagggtcttgctgtgtccctcaggctgcagtgcagtggtataatcacagctcactgcagcctccgtctcctgggctcaagccatccacccgcttcagtctcaatatttaggactacaggagtatgaccaccacatctggctaaattttttatttttctagtttttgagatgaggtctcactaccttgcccattctagtctcaaactctccggctcaggtgatcctcctgcctcagcctcccaagtagctgggattacaggcctaagcccccaggcctggtcagccctgctcttctcttatgacttccccaacttggaaagacttcctgacctccctatctctgcaagtctctttcccaccctgcaacatccaactcaaatgccttcaccttcctctatcaagctcagaatctccacttgacatcagttagggccaaacacacagaccatcatcatttcctgcctggattgctggctggcttttgactggctcatatcctagctttctaagctgactgtgagctccctgaggccaaccatccatcttgcagatccttgggttcaataacaaatgcttactgagcacctgcagaaacctatacagcagcaccctgctgggtgtacagaagaggaaggccgaatccctgcctagaggggagcccctctcatggagagacagatggaacttgcatatatgaccagggtagaaataaagacagggtaccacagaatcccagagtaaaggtcctaatgccatggggaaggggcactcagggggcagggaaggaaaactcagaaagagggagcagcacacgcaaaggattaaagtgtgacatgttctgcacaagagcaggggtgggggaggaagaaggatggagataacgggaacaggctgaactgggaatgctgagctaagggtctggattcatcctgtaggtcaagggttggcaaatccagccggctgcctgttttcgtacataaaattttactggaacacaaccacgcccattttttacatattatctgtggttgcttccaggctgcaatgacaaagtcaagagagactatatgcccggcaaagcttcaaatactatctggccattcagagcaaaagaatgctcattcctgccatagacgctggaagctatgggtggattttaagcagcagatagcagggtcagatttgtgtttcacgtttctatcactctcggatcatgctgggatgtgctggagcaggcaagccaggggaaagggaaggtggctgggaggctggtacagttttccaggtaggggatggagatcaacaacaacattgctgttttttattaagagattcattaagagttgctatgtgcccacactgggctgtgccctttacacatattcatttaatctgcagagtaactgctggatatagctagagttgttatctccatcctactgatgaggcacagagaagtgaagtcatttgcccaaggtcacgcagccagtatgagacagagcccggatgcaaacccagtggtccaaacctgagctggggccctcagtgccaagctccagggcttcagtgtcaagcatgtttttggcaacagatcccttcgagcctccctgggaatacacagaacacaaatcctctaaaggagaaaatctaccccagccgagtcaggcaggaagtgggaggcagcagtgtggctattttggagaagcgacacgagaaaccacgaaacttcctacctgtcccgttttgctcccatctgtcctcagaaacaaggctgcccctctccaagataaaaaggtgtttctccccacacagtggctctgccactggtggtgggagagagagcactaagcttagcacacacttgctatttttaaagggctatataaacaaacagggctatgtaaataagaaaaaaatgaggtcatccttttaaaacctaaaaatgtcccttttctatggggtgagcagcacaacctcagaaagcacaggggtttttctatccccttgaggcttctctagcccatggcctccaaaaaccaccaggcctggctctcttccttgcacccactgagtgaagggcaggtggcctgggagtcaggactcctgggtttcattcctgggtctgtgggctttgcctcaaatgcctaaggccaatgtgcaatcccagccaccaccatccagggaacctgacatccaaccccacgccggtctctcacaaacacggcccatgctccaggccctcctcctcctgtgccagccctggtttggcaagctgattctcctggcccctcgggtatcctttttcctccccactgcctcacaccttgacctgttgaatggccacagaggctctctgcatgccgatcagagtgacgtgtatgctccccacccccacttctctgcacacatgtttaccttgctccacgctcttctgcaccttttcttcaaaggcgcgggccagaggtcattaaagcagccccaggagctgagtttgctcatcaacaactgctaggagacttcccaagcctcagcagaagctcacatggcctccctgggttgcgaagagtactatttccactactgactgcactctccacagcatcacctcaacttctcccctccccatctctcctccttcctcctctgcctccaactctcagcatccgtggcccctccattatcctccagtacaaaaatgagaaccaccaatatttgctgaaggggtagtctccaaattgtgttccatgaaagtgtttcagaggctctccaaatgttccacgagcatgttattctaaaagtacagtttgactcctattctaacagaaaacgagcacgtacacacattcaaacatgctctatagcacatgggaacacactgaatatagccaacaagtgctgccggtttaatttggtttgtgcagacctcagatgaaggtctgggtagatcttgaccttcaccgttgaaatgtatcttcagttaggaagagtggagctcttcactgggtatctttgtgttgtcattttttaaattcaggactctatatgcgtacacaaaaccatacaagcaagtacactctgaagctttcaatgacaagacaatgtattatgtggattatcatgaaaatatcataaatgattgtggggcttcctgtctgacttatgtgtgtaataggaaggaattcaagcagttgttggatattgtcactgatgcaaaccagaattcccttctactcctccccaaatgcccagataatgttgaactgaagaccattctgtggctttaaggcaagctgttaacaatctgtcaccattcacatcatgttatggatgttgatttagaattccttggccaggcgcggtggctcacgcctgtaatcccagcactttgggaggccgaggtggatggatcacaaggtcaggagtttgagaccagcctggctgacatggtgaaaccccatctctaataaaaatacaaaaattagctggtgtggtggcatgcgcctgtaagcccagctatttgggaggctgaggcaggaaaatagcttgaacctgggaggcagagattgcagtgagccaagatcatgccattgcactccagcctggctgacagagcgagattccaactcaaaaaaaaaaaaaaaaaaaaaaaaaaaaaagaattccttaatactttgcagtcaagccaaacgaaacaagaaagaaaaaggaatattagatattgcagctgataaagcaagcaatacaatgatgatctagggcagaggtcagcaaacttcttctgtaaagggccaaatagtaagaactttagattttgtgaaacagacagtctcaagcagccatagataatgcatttaaaaaacggtgtggctatgttccaataaaactttaccgaatcaggcagcagcctggattaggcccacaggcaagtttgccaattcctgatctagaacctcagatttcaatgtgtttgtgcatcaaaacagaggtgtcgctaataacataataaatataacgttcataataaataataaataaatgtcaaaaactagacagccaggtgtggtggtccatgcctgtactcctagctactcaggaagctgagataggaggatcccttgagcccaggagtttgaggctgcagtgagctatgatcacaccactatactctagcctgggcaacagagcaagacagtatatatcaaaaataaataaataaagtcttttgcatctgacttaaattagactaagtctaaatggcaataatttggagataagaaataagaataaaaatgagaatttttaaacaatgttaaaaatttgaacttaaaaaataatgtattcataaaccatcattttaacctgttttatatattgacattccatgcaagatttggcttttaaaaatagcttctaagactataaaagtttgaaaactgctcaagtttctcattgctgagaaattgcttccatatccattttcaaatgagatctgtcctctagcttctcattcagaaagcacatttattctggagaaagccccacttcaggccccttctgaagagtggctgtgactccatgtttccctgccctcagtaattccacacatagctgtgcccaagcctctgatggtgctgatgggccaccccgccctccccagcaccggggcgtttgcagcactgcacacctctgtcttgttcggatgccatatatcccagctcctccctggtggctgggagggccgtgccagcagtggccgtgatcacctggactccagcagcaccaagtcagcacctcattaatcacaggcactttcttccccagggagaacacaggcagaggcaggagccaggtttctcgctggaactgacagctcatttccctctgggcaagtcccatactctacagattcttccaagcagctggctgagcccacacggacaaacaaagagtctgggcacgaagcggggggaggggagggaaatgccaagtctgcagaggaccccccatctgtactccctggacagttcccccatgtatctggcttgcatctctcagagggctctgcttctggactagttcaagtatctgttgtacacctcatggaatgaacccagatcctgtcctgagactgctcatgagacccctaaatggctgtgataggcacagaaggaaacaagtgctaagttgaggtaccaggaagtgccccaggatgccgagccaggggcatgctggggcattacagcatgatcgattcctatgaacatgtggacattcctggggaaggggtcatccttggagctgtcattgctcttcttcaggaagcatcttggtggagaaaaaagtgctgggtcttttgtaaccagaggctctgccccttaccatctgtgtagctgtctttaaactactgaacctctctgtgctcagtttccttatgtgcacaacaggggcaacaggaccagactcactgaggtttgggaaggactcgaacctgtctgtaaagtaccaaccatgtgggcagcagcatcggtccccgtgcttcagcctgacctcagggacacagcactggggccagagggcagggcatgcagatggcacagggctgcaactgggagagcagggtggtggcccaactgcccacacacgccagaagggtgactcacgtttgggaggtccttgttaacgtggctggcaacattctaggggccttccccagcaaccctgcgaggcaggtatcactaccagcctcattttgcaagtgagaaggatgaggcagagttggagcaatttgcctcttaaaccagtaagtgcctcacacaaccactaagagtcggggctgggatttgaactcagggtgggtctacactgttaagtaccacaacaaacatcccctcttaaaatgaggctccaatgcccagttcttccttggaatccagggaacgattcctttacctcctcaggagaaccctggtctaggcctagggctggtaggcccaagctgtcatactgtgggcagagacacaggctctagccaccccgaagtccaggcagcaacagcgatgccatctctgagggctgcctgtggccccatccccttctctatacagtgaggaaacttcagctttcagagaagcgaaagagtcactgctcctggcatgccaggctgggaaatgttgccttggaaatctcagctgggcccacagacccaaacacaggcccccagaaggaggccctggagtccccaagccttggctgcatcagaatcaatgtagattcctgggtccccaacccccaagagtctgatgcagagggcacaggtaggccagagaactccctccctccgtccatccctccctccctcccttccttccttcctttgtcataccaggcaccctctttctaatccccagctctctgggtgattctggctctccacaccagagaaaacatccaaggacttgttcttgacccaacaagcttctaacactgcacacctaacctgtactgaagcctgaacatctagccagaaaccacagcacatacctgaagatctaaatgcatatataaacataagctgataccaggcctctccccaggctcatttgatcactatttcgggagctggggccctgctattgaaattgctgaaattccaagaatcattgccccaaccctgacatcttttcaattcttcacaacttgggggcaggtggggtgagaaaggggactgaagacctgctgctatgtctctaactcccgtggtgctcctctgactaggcattgggtgggcagtggtggtcttcagcaagaaccattatgtaggagaagagggtagacctctggctatcaggagcacacagttggactggcttgtggaggctgtggcccctggagagggggctgtggccctttgagaggagctgttgtgtcctttgccaggacagaatggaaactgaggtactgggagggggcggactgcatttcatgggagacagcatgggaagcagtagccagttgctggcactcaaggtctctactcctgaccaaggaaggttgaggactttcacaacaactttcacagaggcaccagaaaggcaacgataacactaataataacaataatacatttttcagaggaagaactaagcaagctcatgcaagacagaccaacatggcgcctggcaagcatattcagcaacagcccccatttcctacctgtgctgaaggcaccacttccgatgaccaaaactgaaacgctgttctctctgaaagccagcattcatgtccactcctacggcagccaccctccacctaggcgccgctcttcccaccagaggggcgggcttgcttggccaggaccccgcgaggctcctccatgaactaggttgaggctgctgggtttgtgcctcgaatcctgcaggagatgattgagaaacatggtcaaagaactttcttggtcaacttttttagacacagaacaatccctgcctggtccctggaggacacaccccccaactactcccaagcagctttacttggtacagggcctgatccccacatccccctactttgcatccaacacttaacttctctgagcctctatttcttcactagtgtggtaggcagaattctaagatggccctcaagatttccggttcccctggtgcacagaccctgcaaagcccccaggactgtgaataggatggatggttgggttatgttacagggcacaactgaccttaagagagggggattatcaagacctggcctggtatgaaagccctttaaaaacagaatttgcaggaaatgccattctggtcaccagccttgggaaaagtatttatggctaagtgctcaaaagcaattgcaacaaaaacaaaaattggcaagtaggcctaattaaactaaagagcgtctgcacagcaaaagaaactatcaatagagtaaatagacaacctacagaatgggagaaaatgtctacaaactgtgcatccaacgaagatctaatattcagaatctataaggaacttaaacaattcaacaagcaaaaaccaaataatcccattaaaaagtaggcaaaggacacgaatagacacttctcaaaacaagacatacaagtggccaccaaacatgaaaaaaatgctcaacgtcactaatcatcagagaaatgcaaatcaaaaccacaatgaaatgccatctcacaccagtcagaatgtctattactaaaaaggcaaaaaaacaacagatgctggcgagaccgtggagagaagggaatgcttatacgcggttggcaggaatgtaaggtagctcagccactgtggaaagcagtttggaaatttctcaaagaacttcaaacagaacgaccattcgacccagaaattccattactgagtatataaccaaaggaaaataagttattctgccaaaaagacacacgcatttgtatgttcactccagcactattcacaatagcaaagacatggaatcaacctacatgcccatgagtggtggatgaggtaaagaaaatgtgatgcatatacaccatggaatattatgtagtcataaaaaagaacaaaatcatgtccttgacagcatcatggatgcacctggaggccattatcctaagagaattaacacaggcacagaaaatcaaatgccatgtgttttcacctataagcaggagctaaacattgggtacacatggacataaagatgggaacgacagacactagtaactactgggtgggggagagagagggagggacaagggctgaaaaactacctagtgcgtactatgctcactacctgggtgacaggatcattctactccaaacctcagcatcacataatatacccaaacctgcacatgtaccccaaatctaatagaaaagttgaaattatttttaaaaagcagagttttctctggctaatcacaggagaggaagtcagagagattagggtctggagaaagcttcatcataccctcaccgccttgaagatggagggttgtatggaaaggattggcccgcagcttccaggagctgacagcaaccccggctgatgaccagcaaaaaacaggacctcagtcctaccattgtagggaactgagtcttgtcaacaccttgaatgagcttggaaagcagaatgttccccagagcttccagatgagaacccagcccaccaacaccttgattcagccctgagcagagaatccagccactctgtaccagacttctgccctacagacccgtgagctaacaaatgggtgttattctaagtcactaaattggaggagatttgttatgcagcaagagaaaactaatacagcctggaaaactgactcatattcaggcatgggtggcaatgaaatacagtaatagacataaaagcatattgtattccccaaatcacaaaataaaacaggccaagagaggcctgtttcagggcaggagctcaacagtgattcctgaatgaatacacaaatgagtattggtttttaataactgacttgccaggctgttgtaaggatcaaataaggaaatatagaggaagatgctttgtaaactagaaagccgaagttgtttcagtcagtggtggcgtggcgtgtcatatccacgccgtgctctttggaggatgctctggtttgcccgctgcaggcagtgtcgtgggatggatgagaatgtggcttccagggccaggtatacctggttcaaatctagcccttccacttctgacgtctgcaacttgagaaagttgcattgccttgctgtgcctggcaagtggggctaagaatggtgagtgccttccagggcccgtactttaatgagtccgtacatggaaaaaggttggaacaatgcctggcacggcccacgtaactgctctgaatattatctcagagtggaacccaataatctgggtctggagtaacccgcacacaggcctggggcactgttacctttctcctcttgggcaccctgctttttattcacacagcctcagaatcacgtttggcaaccatatcgcactgctgattcctacagagcatacaggtcaccgatgcccccctgctgtccccttcccaatgtacctgctgctatgaaacccagccagccccctcctacccccagggcagcatcgcagcaccacacagtggagaggcttgctctgtggctctatcaatcagttcctgattctgccgtccgaaccagcccaatttctcactactctgtgggtttctatcctccctgatctgacctcatgccctccaatagattgcagttattaatcaaaatggccgtgctctcttcctcccagtgtagaaacactcacttctcagaacacgctattctacaaacacaatctacagtttcctacctctgagccttggctcaggcagcctcttctgcatgggatgctactcacctccctctgcaatcgtgcccaccttgctgaatcctgcccatcttccctcaggaggttcagctagctcccataaaactggacctaagttctgcctctccagaataccccaagcacatttgctgtgctcctcctaaggtaaataacagcatccactgtgctcagccacggcttaaagcccttctagattgcatacaactcaggcagggtcattctgactcactccctcaccccgagtatggcctgtcacacacagtcagtgtggaacaattctctttagcgcccaagttggttgtttattcatttaacagatgtccactcagtgcctattttgggtagagccgggttgtaggtgccagcgttaatagatggcaaagatttaatctctatcttcaaggggagcacggagtaggggtagtcaattttgatggtgtctgaatgtgtaagagagagaaaaaagaaagaggatatttaaaacaaagggagtcatgtaagaaaagacagatctcttgacctcgtgatccacctgtcaaggcctcccaaagtgctgggattacaggcatgagccaccacgcctggcggatcacgggttcaagagatcgagaccatcctggccaacatggtgaaaccctgtctctactgaaaatacaaaaattagccaggcgtggtggcacatgcctgcagtctcaggtacttgggagggtaaggcaggagaattgcttgaacccaagagacagaggttgcagtgagccaagattgtgccactgcactccagcctgggtgacacagcaagactccaactcaaagaaaaaaaaaagaataaaaaaaagataaaaagaaaggacagaggacccccaaatggccagaatgttcaagaaaattgcatggtgtccacatggctggaggtgaggggcagcgacagtgggaggtgctgtgtaggggccgggacatgacggtttgacagatgaagtggcctggatgtggtggtgctgtgaagtgaggtcattttcatcagtgaggtcctgcagccagggtgaggggtgtggcttgaggagaaaggatcaggtggaaggagagagacttcttctggctgcggtcgtgaggctggtgtcactgactgtccccagtctccccctccgtggcaggtcagagggctgcccaccacacccgtgtccaggtcaccagaaaaggtcacacacacctgagggcctagatggcaaaccgagcccatttatctccctcttctcccccccgcaacacccctcaaataaaaggagaaatgtgcaaataagaacagatctgcagtagcatcagctggccagaaagtccgagggaaaacagacgagagggagtgacaggaaatctaatcagagcgaagctagcctcacccagccgggcagtgagggcccacctgccaggcaccccaggacttgctcagagctcctccatggcagggcgggctggagtggggtcctgaaatcccccccaaaaagagtggatcctctcagtttccaaaatgaccaaagtgagagttgggcagggaggtactgggagcagaaagtacctccccacacacctttctgccttcaactgcatgactttattatcccaggagcctctctccctggcaaatggcttcactgttcatcacagaaacctcctgaaggacccatctactcttcaatcaacagctggtgccctacgattctctgaatcccttgcctggcctcaaaatccctcacctcatggcttccaccagtcctggactactgtgttccttacacaaccctaaccaagcccccacattgacacacccaccttaaagagaactgctaggcttcagaaaacccaaccttgcctccttcctcccagacaggccaaagccctctggaatcagcaccctcccttcggcaagtgagtaataaactcagctttgccttaccaacaagtttgtagatgatatctggggagctggcatttgacagtctctacaaaaatgcttggaatcaaattgacattcaatttggtatctgcatcatttacaacagggcagacctccgagcttggaggaaaaagggttaaaacccttagatccgttactcagccaagtctcaaagccagagagaagtataaaatagtgtgacacccaccacccacgcatcttttcttaaaaaaaaaaaaaattactcgaggaatcactcaaaggaaataagaattgtaccagaataagtaattcaaaaaaggacaatataggatatccaagaaacagggagaaataataaaagcagaaaaaggtgaagtgaagtctaaacaaatgttgataatcatgatcctatcttgttgggaattagatactatttaattcttgacatcaatagagaaatctgtgtaaaaactaaccatttctagaagaaaagcaagatgcaaaccttttaaaccactgtgtggggagaggggaagggagaaacaaagaaaactctattaatttagccaagagtgggaaaagaaaaattaaacaggaaagaaaaagtgtaataaacaaaagacataaaataagatgacaaaagacacaataatatgaataaattaaattactttaagttaagagaccaggctggataaaaggaaaaaaaaatccagctatatgctgtttggaaataacacacttaaaacaaactgacaaaaaagatggaaatcaaataaatggaaaaaagcaaatggtaacgaaaataatgcgagaaagccaatattaatatcagacaaaatgcaaaaatgttaattaaatacactaaactggggccttttatattgccgaagagtctatttctccaaggagatacaaaaatcacgaacttttactctcatcataaacacagaaccacaaaatgtataaaataagacattcttggaatcacaaggaggaggtaaagaaagaacaggaaatgtcttgagcattattatttgaaatttggtggtataagtaacctccaaagaagaatacaaagggtttgaagatgtagttagtaagtttaacttcatatacattcaagaaatagagaaaacacctttttctcaaatgtccctgtactagactgcaagaaaatctcaaattccaaaatgcacgaattgtacggaccacagcctcagttcttgatgaaataaaattagacattaacaaatagcaaaaaataaaaatacataaacaaatgatgcacatgacaatttaaaaatgcttttctaaaaaaactcttgaatcaaagaggacagcaacgctatcgtaggataattataaatgtacaacattgagaaccctacttttcaaaatctgagtagtgcaatcaaagctgcatctagaagaaaatacaaagcttagatgttttcatgataaattaagaaaggttgaaactaaatgagttaagcacataacccaagaaactaaaaaagaatgaaataaaccaaagtaatctagaagaaatgaataaagttgaaaataaaacgagtgagaaaatgacagcaaccacaactatatatatatatacacacacatatatacatatatagctgcatatatacatatatgcacgtatatgtatgtatatatacatacatatacatacgtatgtatatatacatacatatacatacgtatgtatatatacatacatatacatacgtatgtatatatacatacatatacatacgtatgtatatatacatacatagctgcaagctaagctttctgagaagaccaacaaaatggacaaatcggtggcaaatctgactagcagtaataggcaaagtcgcaaataatcattaagaaaggtgatgtaaacatatacgtgaacattttgaaaaatcaaagagaatttgatacataactgtgtcaatgaatttacaagttggtgattttctagaaaagtataaattgtaaaactgaagaagagggagaaaacctaggtagactctaataactatagaagaaactatagaagagaaggctgtcgaagatggaattccagattagcagagaaagaatggattatttaaataaaagcactaggacaactggctggctgtttattcattcaacaaatatttattaagaacctactatgtgctgggcattgttctgggcactgggaattcagcagtgaacaaaacagaaaaggtctatgcccttatggagctgagagtctggtgaggggagatgagtaacaaacaaatccgcaggtaaaacaaaccacatggcaaatagtggcaggtgttacaatgaaaattaagcagcaaaatgggtacagaatgaggaagggtggagaatgccattttaaatagaatacacgcaccatagacacacagaaatgtatatggattagagatataaacatcctataaaagcaagttcatgaaaataccagaactattaaaatatttctatactttagtgttggaaaataactttcaaagcccgaattggacctcagtgctcttaatggaaaagattaataaatctaactacataaaaatattaagcattacataaaacaaaaaaccccagttaatcaacagttaaaaagcaaatgacagattggataaaaatatttgcaacatatatgaaaaagtgtcaatatccataatatgtaataagcatccacaaaacagtaagacatatagccaataaaatggagaaagaaaatgaacagatcattgcttaagaaataaaaatgtctaataaatatatgcaaaatgctggcctcgttaataaagaatatatttaaaaatgtggatcacttgaggtcaggagttcaaaaccagcctgtccaacatggtgaaaccccgtctctactaaaaatacaaaaattagcccagcatggtggcacatgcctgtaatcccagctacttgggaggctgaggcaggagaatcgcttgaaaccgggaggcagaggttgcagtgagccgagattgtgccattgcactccagcctgggcaacaagagcgaaactccatctcaaaaaaaaaaaaaaaaaaaatcggtatcaccttttcccatttggttagcaaagaggaaagtgattgctaccatcaagtggtggagggaggagtcgtcatcaaatacttctcaaatactgctagtaggtatagatgaggagaatcttttaaccgtgtctaccaaaatgtatgttgactcggcagctttgcagtgtgcacacacatcatcatacacaaacatacacacacatgcacacatagggatgaccactgtagcactattttaacagtgaggatggatgcagccttaatgaccatcagcaggaaattggtttaataagtaaatgatgataaatacacacaatggaatagtcatgggaacataacttttcttaaagataaacatatactcctaccaataacagagattcattgtggctttgtctatgtatcaagctttgtctatgtgacgtacaagcttcagcgcttctcacaggtagtctccctgcccccctccctcaacagtctgccgggtggaaggtgccacttctgcccccattttccatctgaggcctacagaggctaaggcctgaccaagcggtgaaccttggtctgttagactctggagactgcactctcagctgtgacacacacttcctctcaacgggatggtgaaaagcaaaatcacagacacacatctatctgtgtagctgtgacggatggaaaggacctgggggatgcaatcttgtcctggagggcactgcagaatgggtggggcttgaaacatgcgttcttgtttctacatttccatactgttctttttttaagcactaagcatgtatcacttttgtaatttgaaaatgatataaaagtatagagacagaaggtagaataggggttgtccggaactggggcagagcagaatggggggtcagtgtttaataagcacagaacttcagttttacaagatgaaaacagttaagaggccaatatcttaagtgaaacaactaagaaacagaaaatcaaatactgcatattctcacttataagtggaatctaaataatgtgtacacatggacacgaagtgtggaataatagacgctggaggctctgaagttgggagagtgggaagggtaagggatgagaaatcacttactgcatacaatgtacattatttgggtgacggttgtactaaaaacccacacttcaccgctatgtaatatatccatgtaacaaaattgcatttgtaccccttaagtttatacaaagaaagaagagaaagaaagaaagagagagacagagaaataaagaaagagagagaaagaaagaaagaaagaaagaaagaggaaggaaggaaggagagagaaagaaaggaaaaggaaagaaagaaagaaagggagagagagagaaagaaagaaaaaggaaagaaagaaagggagagagagagaaagaaagaaaagaaagaaaggaaggaagtaaggaagaaaaggaagaaagaaagaaagagaaaagaagagatggatggtggtgatgggtgcataactttttgaatgtatttaataacactaaactgtacatttaaaaatgattaagatggtaaattatgttatgtgtattttaccataataaaaattgagaaactgatataaaagtgtcttctttttagaaaacagttgaacagggagggggctactaggggtagaggggcccatctgcaaggtggcacccacccagggcaggaaggaccagggccagctcctctgctggccccacccaaaatcatgaggagggagggcccttgctctccactctccaccaacacatcaaagcaaggcctttgccagcagctggtaggggccgcatccggtctgggcactgggggttggcatcactgcagctgacaaagggttaaagaaaaatcctggatgcctggcaggggccagcctcactgggtcataacagctgttttccaagggctggcagggaggcaggggggctttggactctggcactgggcctcacacactgatcctaaagaaagtggagaagaaggctggccctgaggcccctgccaccctcctgacaccctcctgacacgtggcccttccctccactctgaacggaacgtctgcagaaggggccggcacatggaaagtcaaatttgatctgtgtggggcagggaattgtgggatgaatctttctattttcagttttatttgttattgtggtctgtgatcaataagaaaacatgaaaatctaagacatgggtcacacatggcagaatcatatggaataatcctggtggttcatgctgggatactggcaaaggggtggatgggaggggaagagagagaattactggcatgcctcatttacccagcaccacagaagtagcatggtatagcatagcgagttggccttaacatcatcagaaagacatgggttcagaccctggtttcatccattactagctcactttcctcatgagtcagaagtgaagactctcaccccctccctgggtttgccacgtggatcagatgcgacaaagtgtatgtgaaatgagtatgaacccagtatacaaaaggcactcaataaatgcctgtgcccttcttcagttatggtgggacaccttccaagtctctctccctctgtcaatctctcctccttctggcttctgttttggggtttggggttggctctgtgacccacctccctctctgtggtcagccttccggctctcactttcctgaggggctcacctttgtttcagcggagtgcgctctagtctgagaatgctgtgacatgcagctgacagcctggaggctgccttgggaaccttcccggtccccagctgtgttctccagacaagaggcttctctctcacatggtagctgactcacggatgagtgaggcgtccccaacaaggagagtgggcagagagacaggcaatggagtccagtcattgatagcgacaagacctgctttgaggatacccagaaatgttttccaggaaagacagggcatttaaaaatagagaatggtgatactttccattgtatgaaggagcaaaaaagaagaacttcaagtacaagataacatattccatttagtggcaggtaggaatatactgtctcataaactctacactgggatttggcagaagaaaagttcatggttttcaggcactgcagggacaaggaagggaggtgttgctggtgtatatggggagcacccagcccaggagtcgaggagaataccggagtggcgggaggaggaacagacgagactggaggagctgcacttggagatgaaggttctgagagctgctggggcgggggttggggggcgggggaaggtaggtgtgggaggagcagtgaggtcgcttcctgctatatcaggccacacctcgcagccctctgtcacagaaagccccctggaactaggcactctacacaggggagcagagaagacaccgtgttccctctctgggtgcaatagaaatcccatgaggcagccccacatttgaggtccagctgcacccagctaagtgaccttggacaagacactctccatcactgggctagaccccagggtgcaaaggtgaagaagaccttgtccatgtctcaggctgtgatggatctagcagggaagatagataagaaaatcagtggttctggccctttctcccagggagcccaaaacctgagctgcttccccgcaagaaggcttctaaatctccccgggttgtagacacagaagccagaggtagaggaagaacccaacatttgttgagtgtcttccacgtgcaaaggctgtccctgcattttttcacagtcatactaatgctacggtcaggctccatcatcaccatctgacaactgaggaaactgaggctttgaaaacagagagatgtggacagccttgcactgcaggagggcccaaggctctggcattaaataaaactggacattactggtcttagacactgtgtggccttcttcgagtccttgaccacctgtgagtctgtttcctcacctctgaaacaagagcaagagtgcacgccctgggctggggtaagaacaaaatggtacggttggcttcccagaaaaatccaccttctccctcttcctcttctggttacttctgatcttttagctttacttatgtttatgattatttcatcttctaaaataagaagataccagatcccataacaagattgctgcaacttattcacagcaaagcaggtggaggcctcgggagatcccggggactacagaacctccaccactggcccacagtaggacaggggcagggagtaattcatgcctactaggaagactgtgataacaggtgtgtgtttttggaggcagaattgctttctgcccacacgacagctgcccccttagctaagaggggaagcctggtgacccagggtcctccggggacccagccaggcttctggtctagatctcaacctgccccactcctgcccagtgctaccccatcttccaccccatccccacctccaccagttcagagattcagccagacagaaaggctgtgccaaaggaaattgtgtgccacagggcccacttggtctgctgtggtgttcttcctttttttggactttgtggctgtttgagtgggtacctttttccatagaaagtttccattgcatcagttatttacattgtcaccacctatatgtgggctctggtttcgagtcggtgaaccagagcaggccctgtggggcccaacactgcttacagggggtgacaggagccagttgctacggcaagaggacctgcagctctgggtcaaccctcagagccacccccaaccctggcaggtccactcttagtgtgctcagtccctttgggatgccatttttagggtgagatttaagagaatttaagagcacaggctactaggtttgcatcccgcctcctccacctcctagctatgctctgagttattgacatgacatctccgggcctccgtgaactatcatttgtaaagtgggaatgacagtggcgcctacctggctggactttgagaaggactcaatcaggtagtgcacataaagtgcttagaacagggcctggcccaaagcctcaatccatgttaatgaatggacaaggatttcctgcccccaccctggctcagaccctactgcccatcctctcttgtgtgaaccaacagcaacagcgtctgcactgtcctgcccagcccaccgatccatagacccagacagactgtcctgatagccagctctcaccaagtcactcctcgccccaaatcccaaatccttcagtggttctccttagagagtaatgtctgcactttacaaatatgccaggctgcctcggcatcaacactcccctgcaaagccccgctcttgccaactgccatgctccacattcatgcctctttgcagttgtctctgtctggaatatttctctccattttaacgtggctaaatccaacccacaccagcctgggtgagcccacctcataggcctcctcctccacaaagccctccatgactctactctctctctggccaggaatgatctttcatttaaggatttgatctctttgtcgtggtgtttaccttctctaccttgtatgggtgcaatataatacatacaaatgtgtgtgggcatcacagacaaaccatctgatctctgaggacaggactgggatgtgtgtgatgcatccgtgtcactcacagagccttgaacataattggtgactgtgagtgaataaatactgaattctctcaatttactaaccccgtcgacagggaaagctatttgggtgtgtgttggtgaagatcaatctgcagcccatcagtgtccacatgatcctctcggttcttcttgagggacccggcagactggggtgtcagccaggggccaggacccctaggggctcacagctactcagactctgagtctcagcatgggaccttgcatctgaggcatgtgtggaagtccaggaaccatcactgacttcttctccctcttcctcagcctccaccttccatatgtcaccaggttctcagtgaatcagctccctaagttcctacgcccatgagcccctctccaccctaccgccaccgtcttggcctaggcttcagcatccttgcctcctccctggtctccccatgtgactcccatccttttctgggtcttctctccatgctgctgccccaagcggtacttctgcatcacagctctgattaggccacaatgcttcttgccacttctgatgcctgctgactgccatcagaaacccagatcccctaggaaggtgctggagtgtctctcttctctaacgcttctaaccctcatccagagctttggtgtaacatcaatcacactgtccagcgacatttattcccctgcacacgggtcttcctcgcagacagggagtgccttcagggcaagaacatgtcccgtctgtacccccagtgcttggcatgcagtcagcctgctgtgaaagcatgctgaacagacgagtgcatgaataacaatgaattaaacacaccaccactgccctgccttccagtgttgccctgacaccaccatattcaggacctcatttttgggaccaagcaacaggtgaagttactaaagtgacagatacacagtctgcctggaccaaaggttgccccagggcacttgacatccctctgtctgtgctgcagctcccagaacccctgatggcctaatgtcagcagggcagatgcttgccctggtgttagctacatggcctaggaacctggagacggacagaggtcttagggtgtttccagaaggaggggaaggaaagtgaagggcgttccacctctggtcgctctgtaccaagaccttccatgttgttaccttcccctctgcccacccccctcaccccctccccaaattgtgtctgccttcccatcctcttttttttttttttttgacagggtctggctctgttgcctaggctggagtacaacagcacaatcttggctcactgcaacctctgcctcctgggctcaagccattctcccatctcagtctccagagtagctcggactacaggtgcgtgccaccacacccagctaatttttttatttttgtggagatgaggtctcactatgttgcccaggctggtctcaaactcctgagctcaagtgatccacccaccttggcctctcaaagtgctgggattacaggtgtgagccaccgtgcctggcaaaccttcctatcctcttattcctcaccagggtcacctccctgtttccctgtcaggctgtggccacctattgtgcctgaagtagctaaactcatggacctatgggacagtacgtgtggtgaggaggtgggtgaacaggacctgggatctgaccacacccctaccattaactggccacgtgaccaagaacaaatcacattctcttctaggcctcagtttcccctcctctcaaaccaaaaacctgaacaagtctgtctctaaggaccccttctgtttaactccctgtcaggaggttgatttctttaccagccagaataattctttctaattaaaggaaacaaacagagagaacgatgtgtctttctctgctgctcctgaaagccaggatggcctctaactctcagaatataagtcagatccccttttgattactgaaggaatgtctccatttggtggcaatcttcatgcccatataacccagggatttaaagcacacttgcatatctgttcttttttttttttttttttttttttggatgttaacaattgggtaagctaggcctttatcattctcattttgcagagtgaggctcagggaggtgaggattatccaaagtcccccagcaagcaagagggagaagaggaactggctcccaggatattataccacagctggcccaggtcgttggcctaggagctggcctcacccaacaggcaggcaagatactttaataaaacaatagcacacatctccctgtatttttatacaagctttcttcatgcatgcagaaacactctgacgcatgggtacccaaagcttcacagtgagctggtgggatgcctaattcctagaagccaggctccacccagacccaacattccagagaacaggcaatactgagaaccatgctttgtccaggcagagaatccttggttttgaacactccagcccctgctgctatcccaggcctccaagcccttgaatcgaatccaggccagcagaagctctgctgcacaagacagggcaatgccttgttcctcttggacccccaggccctgctggctgcagggctccttctctgagactcccaagggagggctgactgcatgtgatctgaccgccacacagggagggagagaagatgagggcctagggccctagaagagaaggaagtagggttgcaattctaggcccttcttccaacctggctctccctcttattgctcatggtcttgtactgttactttaagaacatattgatcctgccttccatattttactgggaactccttaacagagtctccacagtaggtcctccacatgcacctgtgcagtgcacagcctgcacaaccattcacaacctatggcttctggccatcccctgcatagtatgtatcaccactgtaattaaaaaactaattgcataattacttattctgccttcacagaatataaatcctcaggggagcaccaggccctgtttgtcttgttcccaagctgtagcccagcctccagcacggtgttaacagagaataggtgctcagtaaatacatgctgggctaatgaacccaaccaaccattcgttcatgcattcagtttgaaagagagtgaacctgccctgcaactgaaggtgacaggcctctgttgtggccccagctctaccaatgtgtgtccctgagcaaggcatttccctttctaggtctgttccctcatctataaaatagtgtggggtttactctccatgccacatttgcacgaccccgaggaaaagcacctccttaaattttgcaccccgggcaccttgctcacctcacccatcatgacctgaccctggttttctacattttcctggttttgtccagacctgggcttatgggagatgctcggtgaagtcaggagaagggggcttccaggcagcattcaggggatgccaaggttgggagaggagtttttactcctgggctgtatctctgggagagaaaaataacagacagcagtacttccccaggagagcagtgtcttcaaaggccttcttcatcagccttgtttaacctccagcctatggagaaggaaggagggaagggttggctcaagatccaagttaccaagtgtcagggccaggggcaaaccccaggcaccctgtgttcagatccagacccttcagcatgcggacacagcctggctcccatgagtgcggggcacaaccagtttcagccggcagaggcacacacagtagcagaggaaggagatgttccttgcaggagatgggacgggagccttgagaaacaggagggcttatggagaaggatggggtggcattcctggcagaagagatgatgtctgcacagtgtgcctgcaggagaccatgttcaagggtctatgaccactttcttacttgcagagtggtctggccaacggggacccatgagggtgaggcacaaggcaaagctcagatggagataaaacagaagagcacgactacagagtcctctgcctccagggcactccaaggacctcttccccatcatggcctcagcctccctgttgtactgcatactttagttttgtaaggcttctgtaacaaattatcaccaatttaagccaaacttaatggcttaaaacaacacaaacttattatctgagaggtctggaggtcacacatccaaaatgggtctcactgggctaaaatccaggtgttaacagggctgcattgctttctggaggctccagggaagaatctgtttcctccttttccagcttctagaagctgtactccttctttggctcatggcctcctcaaagacatcaatggccaggtcaagtctttctcacactgcaacctcctggcactgactcttctgcctctgtttaccacacttaaaggcccttgagattccactgggaccttgtgggtaatccaggacaatcaccctactctaaagccagctgattggcaatcttaattccatctgctaccttccctcccctttgccctggaacccaccatactcatagacttcgagaattaggatgcacacacctttgagtggggcattattctgcctttcacactgtgtgaggcacatctcctccaaatggggttttggaaggaaggtggcccaggatgagagagatggggtggatggtgtgggcaggagagggaggcaggcagacacacactcaccctcctggctgcctgcttagcacacatcaccattgaaaactttgtcatgtttccatgctgaaccgggcacaagctgtttccacagtgactgcaagagcagaagcagagccagaaataaccccactgacatggaaagcctccccttcccttggtactttgctctctccttctccactctccccatcatagtatgggaggttccagtgggttctaagttggaggcccttccagggcacgctgaggccttggggaacactcctcctgcagcctggctccagcagggggaacatagggatctgactgtggggctgggcctggtcacctcatttccacaccactgtagtgagcttggagtctcctctcctcagcctcactgcctctgagccacaagtccctacaaagtcccaatcgctccttcttggatctcttgccaccaaacactgggatccgcagaacactcttggtctcttgggccagaagcccatgggatgttctgatctggccccctccttgggcctctgggaggcccctgactggtgaggccctgcctggtgggcctgggacccactctcacaagccctgccagcccccagcccagtccttgctactggtgagccttgccagcctgctcagtctccctgcaccaggagccctatctgggaagctgggctcaaaccctaccttctccaaaagcccctctttctacaggttttttccttagaacaagatctcacccactgcaggggctgaaacatttgctgaaatatatagaccaacgaatgcccgggcctcaccatccataccactccctcatatggcattgtgtctctatggccctgggaaatgtcctccacgactgtttaatttctcatgtctttcatcctagtccgacaaaggaaaatggagttaatgcacctcctacctgctgggcactgagcaaagtattaaacgagcatgcatcggcacatttcatccctcacctccactcaaccatcatcaccaccatcttacagagacgcaactgacttgcccaaggtcacatagccagaaggtggcagggcccagactggacctctgtgtgccagactccaaagcctgaggctgcagccaccatgtcccactaggggggccaggggaggagacacagagatgatcaatagcaaatgctaaacgaaatgtgtccaatttgcctcctagaaagccctgagcagctcaaggtgtctccaatttttgtctctttgtatgtattgggatttggcctaagattttatttgggttttcaaaaagttgggaggatatggaggggggttacatgaatttaaaagttcggaggacatggactgtaggccaaccccatccttgtaccaatggcaagaccaaggcatggaagtggaagtgacttgcccaaagtcatggcctctgccactgaagccagtgaactccacttgtttctcccacccattccttgatggagaggacatcgtatgctccacttagcccttggcactgcttggcacagaatttagagtccaatgtggtatgggtcctggatcctgctttaacagtgctgcatagttgatggcttggtagctcaagtgctcagagcctctgcgtccttgtctgcacagcagagcctgtgtggatttattcgagaaggcatagacctgctttggatcatataatattaggatcacgggtaacagagctgggccctgagccacttctacgggaagatggaaagagctctatatttagactcaaaagcctcaagtagagtcccagttctgatgctcatcactttgtggccggagcctcccacttgacttcattgagtcttactctgggagacaaaaatgtctcccataaggggttggtatgaattgaaatgaggtaacacatgtggaaacactggaggcataagaatcctctgggttgcagaatcccaggctccaccttctcccactgtctgattctacagctgcggggcagggcccaggaatctgtatttccccaatcccctcattccccaccatgattctgttgcagttagtcaacaggccacactgcaagaaatccctctaaaaagggctcaatatgtgtttgttaaatacacgaatccttgaacatctgttgagctgcatatggctgctaggagacatgggccgaaggaaataagtaattttccccaaatacatttcctatgaaatctaaatgatgggaattgggttggggcttcgaagactaggagatgatgcaataatagcttccttctccaaagagctcctccccttagatggggagagacctggctggagggtcatgcccagtggctcaggatcaaatgcggggaggggtgctctggagacggagtcccctggggatgagttccagaccctgttctcttcagcatcttcatgaagacaggaaagaaataactgaaaatatgctcattaaatctgcatctggcacccaatttggcagggttgccaaaattctgtaagactagaattaaattagcaaattgcaagtaaaatgattttaagcaggcatgatggaattcatcagggccaggtggaagctcatgggggaagggagtcaggaaagcccacatccccgggggtgggaaagcctggccgggaacggaaacggaaaagaaacaaaccggcaagcagaaatgacccaaatccttaagattcacccttggaatgtggtggtgacagaggcagccccacactgcaaggtggctagaggctccttctgggagccaggaggtgtggctgggcagcacccggttaaggatggcagctcttcaaaagagggtcaagaagaaaggacccgagggactgctggggaatgggaggggtgggtcctttagactggcggccccacaagggcagacacgtgggcggtgacagagcagtggcatgtgttgacactgctgaagcaccattgcgtgcttactgatctcacagtcagggaaaaacactggcatgggcatggcgggggcaggggaggtacagactctgaggaaggaagaagaggctagaagcatttcctgggcgcttgctaagtgtcaggcactgtgttaaatatttgtcaagtattataatctcatctaatcatcacaataatcctgtaatgtaaagagtcttcttttctctttattttcttgggttttcttttttgttttctgggtttttttttttttttaatgaagagatatttaaagtaagaagtagacaagtcctgcttcatcctctcaaagcctatttcccagatgaaaccaccaagcatagttcactgggcttgttcccaggctgtttctctgagcgcagaaacatttctacatgtgcatacacagacttaactgtttaacttttcctgtataaaaatgagattgtcctaaacatattacacagaaacctttttccagttaagaatacattctgaatatcctcccacgttaagacctgaaggatcatttctttcttttgaaatggccacaaagtattctctggcacaaatgcaccataaattttttaagcattgtctctgctggacactgaggtcatttccaatttctctctatttcaaacaatgctacaagggagtacctttgtacacatatatttttgagtacatatttttctatagccagggaattgctggaccaaagtgggtacagtcagctctatctgtgggttccacatccatggattcaaccaatcgaggatcaaaaatagttggaacaaaaattccagctgggcgcagtagctcatacctgtaatcccagcactttgggaggccaaggcaggcagatctcttgagtttaggagttcgagaccagcctggccaacacggtgaagccccgtctctactaaaaatacaagaaattagctgggcatggtggcacacgcttgtaatcccagctacttgggaggctgaggcaggagaatcgcttgaacttgggaggtggaagttgcagtgacccgagatagcaccattgcactccggcctgggcaacaagagcgaaactccatctcaaaaaaaaaaaaaaaaaaaaaatccacaaagttccaaaaagccaaacttgaatttgttgtgtgccaaggactatgtgatccacataaatgaagtgatatgtaggcaatgtattaggtatcgtaaataatctagagatgacttacatatacaggaggatgtgtgtaggttatgtgcaaacactacaccattttatataaaggacttgagtagctgtggattttggaaccctcagggcatcctggaaccaattccccatggataccaagggatgactgaatatgcatttataattttcattgataccaatttagattctcaagaccctttggcccttgccagtactagatcttctctattttttaaaaatttttttacattttgccacctctaggcagtaacaatctcatttttaatttacaatctttggttttttagtggctagagcattagtcatatatttatgggccatttttatatctgtgtactatctgtttatcttttgcacatttttaaaaacttggctatgtttttagttagttgatagaacaataattttctaactaatagttctttaaataataactaatacatagctttctatgcacctggcactcttctgggttcctgacaaacttcacagcattgactcaaagccccgagaggtggtcacagcagtccatgtttatagccaaggaaagggaggctcagagatgtcaagtaacttgtttgaggtaacacaggtcagataagaacacgccagagtctgaaggactagctaagccaaccacttcatcacgagttagttctttctgaagccttcccatatgtcccttgccatctaatccacagagaaagaaaattcccccttaaaatttccctctctgttatttatcctttgcttcatttgcaaagcctttaaaagagtattattctcatatgccaggtaagaaactgaagtccagtttccaacgagaggcaatcatagcatggaattggcccctaaccctgatatgcctggggacgtgcctggaggagtgaggagaaggatttggcatggggcaggatttacacatggggccgaggatcagggaaagtggaggctgaggcagggcccaggatggcaagagttttaaagagcaggccaggcagtctacaggactcaccctacgagcaacgtggaggggtgaaaagctgggacaaggagtcaggtgaagatcggcctagtgagaaatcatcatcaaatcagagggtgtccccacctcaccggccatttccactgaccaggcacactgaccaataaagaagcctgccctgcggggtaacaaacacacctgtgtatatgcaggtgctggcaactctatgtgtgaaagctatacatgacaaaagggtttttggtctttagtggcattttaaaataaggttcttttttagctcctaaacaccaatgtcacatgtgggtttctgggttacaaacccaccattgatttgtcacatgagcttggttaccctcgtctcaatgagcacacacaatacttctgcctcccatgagcaccgcacgtagggaagggaaaaggatcatttgcatgccatttttcttctgaggataaaagaaattaagctaacaaagtgggaaaaaatgtgagaaactgacatgctgaaactaacatgcagaaataagttttaagtcactgtttattcactttaatttttttagctttgacctcagataaccttagcatttccccaaatgtttttctgtggaactcttctccagctattctgtatgtgtctaaatgtgtgtgcgtgtgtgtgtgtgtgtatgtacataacatatatatataacatatatatatatttgttctctgatcaattaatcttaaaaagctgcacacagtacccacctctacacacacactcacattcacaaccctcacacacacatactattttgcagatacccaatgcacttctgcatattaaagactgagaactcctgcaggataagggtctttaaagtttcccaaatgtacttggccattggactttcattttctccctgtaacacatctttacaccccatggcacttgtggtctacaaacacaccatgggaaaagctggacttctttatttcataagatcagagcttgcttaaaataaagagcccagatatcctacccttttaaaaaacagatgggttctaatcaacccatgatgatgatggtttcctgcccacctgggcatctggtgcctctcctagatttcagggcgacaccaaatgttcgcatgccaaggcaagaaaccgttaggaggccaggtgtcctgcacaggctaagctgtgtggctcagcagttgaagggtgggtctggatcaatcccttgctcagtggctttcagcccaagggtccccagagactcacctaagccaactcacttgttctgtgaatggagaatgaggcactaagcctcaaaatcccctggcccctgttctctttcatccactccatgagacacctctccctgggcctaaatattttctactgcaaaaaaaaaaaaaaaaaaaaaaaaaaaaaccagattacctttaaaggcctttccagccctctgactcttctgactctgttctccttgcacctactccttcccagctatcgtcactgcaattcattatatagatatatagtcacttgatatagctctacaagtaaaactatgtttctgtctgttatagcatcaagtgaaattgagttggtgaactttcactgaatacaaagggcatacttggcctaggttaaaatgtaagttatacggtatacatgaaattcacgtgggggcagtccctggggaaggaatctccaatagaaaattcctctgccagtgttgttacaggcactggtttataattttgctccttctcacacaggcaactcaggatagttgcttaggatgaccagtaacagagatttaattacttaatgactctttatggctttcctaagcaacccttaggaggacagctagtggaagtgtatatggattcattcatttatttttaaataaaatgttcatttttggaatagttttagattgacagaaaagttgcaaagatagaacagagaccccatatagcttctactcagtttccttccatgtgaacatcttacataacaaggtatatttgtcagaactaagacattaacattggtacattactagtaactatttcaccagtttttccactaatgtcctttttctgttccagaatccattccagtatacaacatggtattaagttgtcatgcctccttcatctgtggatttattattgttttcaagaaatagacaccattctctactgcacgcagggaggtatgctgggtactacagtggatcccagctgccctgcagggagaaacacagtgtccagtggagagcaagtctgggtttgagtgtccattctgcccctcatttctgacacagtcctgggcttgtcaccccacatctatagttctcaggttcctcaactgcggtctggagataataccttctagcttgtgagagagctgaatgagacagtctacatggaaagacattttgaaggcttaaagccctgtcccatgcagctattattattattaaagttgctgtaacgattatcattaagcatatttgatacactgtttccaaagcaggacagcccagagtctgagctgtctgaccgagccgacccttccagcttcaaatgagatgtttccatagacctccacgtgccccatagagaaaggaaattttccttagtctgttcagttctacacttcctttatggctccattcatgggtcaccatatcagtgataccttctctgaccatcctacagcaaagagcctctgaggccgcgcgcggtggctcatgcccataatcccagcactttgggaggccgaggtgggcagattacttgaggtcagaagttcaagaccagcctggccaacatggggaaaccctgtctctactaaacgtacaaaaattagccaggtgtggtggcgggcacctgtaatcccagctacttgggacgctgaggtgacagaattgcttgaacccaggaggcgaaggttgtagtgagaagagattgtgccattgcactccagcctgagtgacagagtgacactccatctcaaaaaaaaaaaaaaaaaaaaaaaaagagagggagagagagagaaaagagcccctgaatccctccccacggcattctctaacttcccaccctgcttcatgcttctccatggcactgaacccatctgacacattccctattgccgtgttcctttgttcacgattggcctccctccactagtttatgagctccctgagagccccagttgtggtctgttttggtcagtgctgtaccccagtgcctagagcagccctgacatatagtgagggctcaacagatgtctgctaaatgaatgactatatgcttggttttactctgtaatctcttgcttccaccctggtaacttgaaaacaactctttacacccaaacatactgttgaattcaaatcagagcaaagctatttggtaagcaggtggctcagagccctttgggtcttctttaagaaaaaaaatagggtaatgcctttcttttaatttaattcaatgtcatgaacgtttctttgcctgcctcctctcccatgagtggctctgccaattagaaaccacagtctcttccttgtccagagcctgtctgctggcctcctcacataatcaattccaacagagtccaggctagaaaaagctggtaaaatccccacagccccacacgcagccagttcacttccttactgtattcactcagcacttgcacatcaaaggcccatggacttctcagagcaggaagaaacccaggggatccctcaggccagcctgcagctgaggacattgtggttcagacaggggagggaactggcaaatgacacacagtagttagtggcagttccaggaacagaacccaggactcccagctccataccctggccccaattcctttgtgggctggaaccatctccccatgcccgcctttcaccaaggaacacgtacgtgcttattacctggagctctaatctgattgtctgcccacccctgaccattcctgggtatttgaacttgggcactgatgggctgagatgactctccaaagcagcaatgcaccaggcagcagagttaagagccagacagaaaggaaacgggggttgcatttgttcagagccaggtactttacatgctcatctcaactaacactcacagtgccctgaaatgaaggcattataactacattttataaatgaagaaaatgaaacacagagaacttaaaaatgcagcaaattacacagtgagaaaagggcaggaccagcatcagagtcaagttcctcctggtaaggaagcccttgttctcctgcccgaccactccatcagaggcccaaaggcctagacagcactccagagcctgttgggctgggtccctaaaaacaacaaaatattcctctggggaagtaaccagaatgatcccattctagagatgaggaaactgagatctggagaggaaatacaacttgcacatggccacgtggcttgtgggtggtagatttgctcaactctgagcttcttggggatgcagactctctcctagtgcttagcccagagctgagcccccagaaggaccaatccactgttgaataaatgaataaatgacagcgtaaggtgagaagcacaacctcccgacactcccacaagccgggtgtttacaccccaattgacccacacggtggcctcaggagcaagagaccaggctgatgcaggtgagcacaagcctaaactcacactgatatccaaagctcacatcctcgtctctgagcccatcgatgtcagaggcatgggaagtgatgctggccctggtccccattcagccctcagctctccatggagcaatggttatgcaatgaagaggtttaggaagatggcggagctggtaattctttcacccaaagactgatgtttatggcatggaatgtaccttcctcccaaaggctggtgtttggggcaaattggtctattttgttgccccctttgggagcagctgattcattcacaaatactgcagtttttattattctcagtaatttttcatcctaacaactgaaactagttgttgtttatggttcacctactaagtgccaggcacaggtatctaatgagacatctgtcaccctgtaggtaagtgtgagcattcccacatcacagatcaggaagctgaggtttaggagaggcaaagcaaataggaaaggcacagggctagaaagcaggagatataaactccggtctgtgggacgccatcgctcatgctcctaccatgtggcctttgcaggtccgggacaagggggtcggagccacagccaaggacagatggaaatgggaggcagatggaaggcctgcctgacttcctgggcctcctgctggctgggcttctcatcccaggcagaacatctagcaccagggcacttctccacatgcccacatgctgtccccagactctctgatcagacaatcagggtggaacttggagctcttctgttcaaagccctcaggtgacagcacctggcacccctggttaagaaccactgctgtcaattctcagaccattttctcacaactacaccctcttctggaaggttcgaaaatgtttcttaagaaatctgttaattggtttacaaagaatatcacaactcaaaaccgctgagaccttccaattctaagattctcaaccaagcaacaataactcatccacaaatgcatgtgaaggtttgtctttgttaatggcaattattcccaaacagcgtgatgtttataaaaaggactttggagcccaaagtcctgggtttgagtcctagctcaaaccagttatttgaccacaggcaactcaactcaacctaatagttattaaaagcccactatggacccagagtcctgggctgggaagactagggacacagaagcagacaaaaaaaagtcatgatccctcttagctccgagttcctcatctgtaaaacaggaaccagcagttaccaagtgcctgctacacccccgggccttgaaagtgcatgttctcacttcaccccccccatgagcctcgggaggcaggttctcctgtgatcctgctctgcagcggaggaagcaggggctcaagggggtgaagtggcctgggtgagcctgcggcagtgtgtggcagtgtctgcactctttccatcccatcccccgcttggcagattagtccacagagtgaacaggataataagggagagtgctctgcagccgatcaggaaccgcacagatgtatgacatcatggttattaataatggaagcagcacaactaattcacaatccttccagatggaccacctgaattgtctcctaaaaacctcctgcaaacagagcatcgaattctataacggtagagctaagagggtccttagaagtctgaccttttcctcatttacaggggttggggatggacagatctagagggcagccccgccccacaaagcccaggatgcactgttgggctttagtgattgaaccaggaagataagtaggtctcagatcaaacaccagcagttaccccctccaaagggtgctggcaagaatatcagcagcgaactgcaagtatggcctcttcctggtccctagcccagctcctttctgctacagggcctttgtacctgctgttcttctatggcaaatattctttccccaaagctttgcaaggctgtcacttctttattactcagatctcaagataaatgtcagctcctcagagaactctctgggcccccacgtgtagcttctcccattcctccctggcattctccatcacacagctttgtttgagtttcttcagagtgtatatgacgacttagctttatctgatccattaatattcattatttctcttcccactggaatgcaaactccctgaaagaagggattaaacagttttcactgctgtagtccctagaatggtgcccagggcccagcaggcactcagcaaacatgttcatcaagtccccctggatgttggcctgggtcatggccatcctagcatctggcagacactcattcaataaatgctattgaccctctcctctatgccaggctctctgctagatgctgcggtccttgccctcacagtgctttgacattgattaaagcaaacagcacaggagacgccagagctgtggctgtcccatcacatgcaaccaagcaatagtcggccaatatccacaaatatggcagaaaatggaagaaactgggagacatggaggaaatgcggcgttgggttggccctgcaaagcactcccacatgctcagtactcatcttggggagctagtgccaggcaccccctcaccagctctggggacacggggacaaggggacatccccattgccacaactacctcatagctgcagcctagaacacaatgggatgaatgtgtgtgtgtgagagtgtgcgtaggagcagatgtgtgagtatgaacaagtatacaggatcgcataagtgagagtgcatgggagtgggtgtgtgtagaggagcagggttgtgtgtgcgaatgagtgaacaggatggcatgtgtgagtgagttggagtgggctgtgggtgtgtgcacgtgtaggaacaaacttgtgtgtacaagtgggtgtttgagtgtgtaagagtgcacacacgtgtgtatgtgtgcatgtgtgagagatgactgtggtaccattaccaagctcttcaccacaggctccacatgtggttgaactttacatgctaaagtcttcaaaatgaaaggcacagagttggtaactggtcatcacttaattcattcaacaataaatcatttgactctttatgttttttaaacacattctgcaaagtgtccatacaaagcagcaagactggttctagaggaaaattctcaacttctggatgtcattcagtgaggtgagagcactggatggggagtcatgttgcggtccgtgctttaccactaactactgggtgatcttgggccactgtttagctgtgtgacctcagatgagcctcttaactgttctgggcttctgcttactctccattaaaacagaccaattagaatttagctctcaaagtttggttgcaactgtacaacactacatcatctctatgggtagcccctgaagcactgtttccttggagagcaagcctactaacttgaaaagggcccgcaactagaaaaaaaatgctgggttggacaaagttaaagagtcttttattgcaggacttctcagagcctttcatttgccagtatggattgtaattggccaaaagggtaatagagagcttgcacaatttgccattcttactctaacagggaaacctttactggtggaacagctttcagaactaacaatccactgaacacactgggaaaatctgctactaggcacacaggacacttattaatgaccccttttttgcagatgatggaacagaaagggtgttctaagtcacagagcagagccatgacaactaccagcccagaaatcatccaaaccacagttactggcacgtgcacaaggctttacatctacaaaacattttttacttacgtgatctcaatctttcttaaaaacatacctctggggacactcattccatttttgataaaacatagcctgaaagagacgaacgagtctgcccagagtcactaagggatagacccataatttggctctatcagtttcccctatgtccttgatgaaacatcaatcaatacattatatttttatagataaacaactgtggccactatgcagagatccctgcaagatgccaaggctgatgctatctgcacctgttttgcagccaccaccacttctgtctgaagcccaagcaccctgctctgattaaggggggttggggagggtgctctcagaaatgcccctggagtagaagccgctctggaaacatccaggctgtgaagtgggagtagatctctcccagtcgccacaccctcctgaccatgccaggtacaacccgctaggatgtacccccagtgccagctgtcattatgccgggaggaggggctcctcggaggatccagagcaatgctagtttaactcactcccaatgagccccgaggagccccaggctggtgggctctgacagactgaaactgcatggccttgggggaagctagggctgccaaacccattcagcagctcccgccgggtgtgccgtgtcccacggtatgcgtgggtgcgaggggtgagcgccgcgccggggtgagagtctgcgctggacacaggaggctgtgcacgccaacggccgtgccaggcgcgagtgtgccagagaagtgtgtgaacgcgggaacgcttgtgtcgccctagggtggtgacagaagtagtgtctggaaaacgctggctgagagcgcgtgcatcaggccaccgcaggctgcgaagaagccggggcccctcactccaagggtcccgggagttggcaccgacgcactactgcaagcgcgcccgcgcccagccctctcccaccgacgcggctccctccggtccctctgccgcccgctcggcggtgcccggtccctgggctgccaggccgcggcgggggcgcggcgcgcggggcgctcgttgcttacctgcgggcggccgaggctccgctgctctgggctgggctgcgccgcgctggactgggctgcgctgggctgcgcgcccggcctccgcgcggctcggcagcgcccgcgcgctcggctccgcccggctcggctccgcccggcggtgccccaggcgctcgctggcggcccacgcggcgcggggtgggcgcggggcgggctggcgggcgggcgccggcggcgggcgcggctccgggccgccccgcggccgcttggaagctccttatttgggcagtgatgtcaggggaagtcgcaggggccggaccacccacttctttccattcactccccagagtttcctgtcgccgagcacggggaccccgccgccggcccggggcgcctctcccgtccgctcggcctcactgctggccaccccgggatgccttcgcggccggggtcgcagatgggcccgggcgcggctggcggctgccaggggagggtctcctcgcccggggaatccctggctgccggcggccgcggggagggtctgcgcgccggcctcctcggtgacaggccgtgtcactccgggcgccgcccctccctccgcgcccgccccggctccggcgctgtcttttcctcctgggccctctagggagggcagacagggaagcccctgtcgccgccgccggggccctgccactctgcgccacgccttggtcgcacccgggcccagcgggagtccatcgccgtccccaaagtgtgcgctccccgccttccccctgggtgccagccgggctccgggaagcccgcgcctccccaggcgggaatccgctttaatgagctctgggcggggcgggcctgccagggcctccctgggctcaggcctggggtgggggcgggggacaccccggggcttcccaatggcttgactttaccagaagctgctggatctcgggatttgggcctgagtcactctggtccttgctctggccaggatcaagcacacttgagccagttcccagccaggcctccacaggtctgcgggaaggccaggaccctgagatctctctccgtgatctgttatttcactgatgcccaccagaggttatttggcagaggtcaaccctctgccacagtggaaccagggctggccctgggtttggctgactccaggaacagcctcaggaggagacaatggagctgggggtcgggggtgtagagtggggttaagccaggactagagtgaggtaagttaagtgcctaggatgcagaatttaaccaagcactccctttcagggtcatgaaagtttgaggccccacaggggaactaagcactatgctgacccaagtttccagggggatccttggaggctccaggtttcctctggctccaaagtcatgccctcaacttctctaggcccaaagggcggattagtgaccttgggcatttgtgtgcctttatacaacagcctctgatagagctgccacccttcctccaaagccagatcagagcaaatagactcctcccagacccccagctttaatggagggaacccccaccttctaagaggcactacattcctaggggcagagaggaggaagctatggctccagggcttgcagagagtcaaggcaggtgtgattgcagctggacatgggtctgcacactcacgtacacgattgcaaacccactgaccagctgccaagctgcccagctgttctgtggatcaccaccaccccagtctctctcaacttccatcagctcccagggcccaatcccagctctaattgggtcatcctccttctgacaaagccccaaagggaaggaccacacttcctgatctggcatgcaaggccccacggaccagctgcatctcccagagctcagcccatcctgccatttgcccagccaccacccccaacacgcaccactttgcaccagtttccacttcttgaggtcttcatacaggctttccctttgaaatgtcttctccaccccctccagctgtccttcacaccctgaatccaagcctgcccttgatacaggtccttctcttgagcagggcaactggggtggggtgccccctgggacagattcctgctcctcactccactcctgccctgcccccactgtcctgcttcccgttttctgtctgaaagcaactccaggcagaggaggtgggtgccttgttataattcatatgccctgaggggtgactttctatcattcacacacacaggctcagatgacagccttgctcctgccccaagttgaatgacatcctcctcccctttgagaggtggcctggcctcaagggaccctcccaatggatttggtcaccttccatgatgccacaggcaactcaatagttcctgcctctacagacttgcccatcacctcacattgaagtcagttattgggggcctcctcttcctcagactgggagcttcagggaactttccatcttgatccctctcccctcccaggactgataagtttacaaatgtttgttaagtgaatgaatggtcctgaggggcaaatcctaagacaaactaaccagaggacgggggagaatttacccaacccagaacagtggctgatgtcctagggtccctggctgggggctgggatgaaaggcggggttctcagctagactggcttgaatgctcaggagactgggatggcttgggatttgtctcctcctttctcttgacaaactcctctgcagccatcagggagcctgggatatccccatgccaaccccccaaaacacggagtcctgagctggccctaatgaggtggaggggaaggatgaaggaaaatgcaatttgtcaagccctttcattgtaccagacacagtcagactggatgcccctgagccttccaagccatgcaggcctttccagcggtagtcattccccaggccaggagtgtcagctggggagccctcacctagctcctcccacaaccatctgtccccacttcaagactcagcccccacctcagttctggtgccaattctcactggaagccagaaggtcttcaggactccagcctcagagctcagagaaagaaggtgggggcagacagccctgcttcgaggctaccagcctgacctcgactctactctgtgagcccccacctgcagaccaggcctccaccagtctgcagaaaggcagagttgaggtgcaggacacctttcccaccatgtatctgaaaggcaggtggtaccaggtgccagttccttcctatcagccccatcccctgcaagtaactgggccaggtcttgagaaagtcccagtacttggccctgggggccttcccacattcctgcattcctcaaacatgaatcaggcaccatttctgtgttgggaacatgtaatacacaagcctgtgttcatggatggagactgacaggtaaacagatatcccattgctaaatgttacactgctgtttgacaaggttggagaggggtggagtaggggcatacaagatggaaagataagattcattctacttctggagctacaattcaagaaaactgtgatccaggtgtcccgggctagaatgctgaatgcttgtttccacggaaatgttatacacacacacacacacacacacacacacacacagtctggatctgctgtaaagccagcatcacactgtagagactttacaagctaaaagagattagagcagagggcaggtttggcatctgatctgccatctagaaagctatctctatggaattttgtttccagcttataacaacaaaattagacacaattttggaacccactgttgctcccaaggagctagggaccagcacagtgtgttgggagcacttttaaggtggggtggggctgagcaaccaggccctgtgggccttctgggttatttatgtttaggtcttacactgacttagcaaccatcccctctccatcctccatccccattgctgtgctttcctggactcagatgctttggttgttttcctgtttggggtgtgtgtgcgtgtgtgtgtgtgtgtgtgtatgtgtgtgtgtgtgcatgtgcacatgtatggtaggtgctctcttcatagacctgttgcacacatgaagcttctgtcctgggacagagactagagtttgcattttatggatatcaccttcctgaggtccagtcctccagactcagttcccatcctttctctccagcctgagaactgtgtttccagcttcctgacttaacttgatgctgtggataacagcatgggccttggagccacatagacctgggttcaggctccagccccacatttactgtgtcaccttgggcatgttacttgatgtcactgatcttgacgttctcatctccaagggctgctgggaagttttgacaagacactgcaatagaactcttcagtgtacaaaatagtaggtgctcaataaacagtagcattgattactgtcctcccatatggtgactcagaatcctcctcctctcatactgctcatcttcatggatgtgggcatcaatcttctcaagcccgaagccagaagcccttctccatgcctggtgcctcaattcaggccaccatcaccaacaagttccaacagccttctccctggcaccgtgcccagcttacccctgcaatccattctccacacaggtagaactctctaggacaccttcaagtgggtccctgttcagcgaaaccacccggtctattagggcctttaacaacagagcctcagtttaccagtccaaacctccctctctctgcactatccccatccaccctatgctcccaccatacagaatctctcactgtttctgagccttccaagcacattttgcacatgcagttccctatacttttcccctcacccatctgcttggccagctcccactcagccttccaggccagctcagaggccacttcccttgtgaaggcttccctggcccccagggagtgttggcgtttcctttgccatgagcctccagcacttgatacagactgtcctggcttgtgccccactatgagagtcatttcttcatgtgtctgctgcccccttagattctgcatctctgtgcatgaccaaatcttagctctaggaatgtcacagatattcagagcatgctgaactgttaacacacggctgctctgaccatcctgcctggtaaccagcaactacaggaggccagttggcctcaagctcatggaatagttttccccaaatgacaaaagcatcctcttttcctatacttcagactgagacctgggtctggcctaagctctgagactgcctcattctggcttttcaccagcattttgggggactcccacagggctcagcaggccccaggtggggaaggcggggccttcagttccaggaaatcagaagattagtcaagccacactcccctggcagctgtgagaacaggttttccccaagccaagggacttgcaagatcatcaataacaacaaatatttactctgcccatggctttgtgcccaccaagggaggtgcataagtacagcatcaacttccacagcttggattaagatggatgtgggtgcatgtcctggtcctgacacttactggctgcttaactcccctatacctcagttttcacagctgctaaattgggagaataacacatcccaggaaaaatttagaggaataaattagagcagataaaattaaaagagaaaatgcatttaaagtatcaataacagaagcaatatgtattagtcactcaataaagaagccccccccaagccccccaactcaagctctttgggggatactatgatgaacaagacctagtccttgccaatagctgatgaagtgagggaagggggacatgagaattaaatcagaccctataaacatgaacacaaggtaaacagcaacaggaatgacaaaaaagagttctgggagtagcagagggagagaagaattctgagatgcccttacattcttcttctctcctgagactttcatccaactgattgatataatccatgtggccagcccagggcgaagggctgggtagggcagtgggtgggcaggaaggaatcccgaggcaagacaaatgaggcctgaaggatcctgtgctcaggcagctcacagtctggttccggagaggccttgcacactacagaaaataactatgacaacagtggatgaaagcagtgaatgctgccgaagacatgggcgagagagatgaatacgggaggggtgaggcctggtgcaaaggctactttcaaaagcctgcatccacagcaaaggactgtggaagtggcctcaccccatccctgctcaggctctgctcccactgcagcccttctgacctctcaaggccagaggtgagaaccccaatccttcagccttgcaatcttcccacttgcagtcatgcccaggaagggagtggcctgggccagacagctcactagtccgtaaacataatgtgaatttggatactccacttttccccatgctgttccttctacctggcatgcccttcctcctcctatcccccatccacccttccctccagctcccctgtaaattctctttgcctatttagtgaactcgtcctataagctctccttcaaaagtcctgtttttcttattttttcctgacttccactctcagcagaattgaaagcacccttctcagtgatgttctggtaattagctttgtatataccatcaaaatatttctcacattatagtaaagtatttgtgtctggtgcccctactaggttaggagagctctggggtcaatgcttggtacctactaggtgctcaataaacagggcacctggaaggctttctcctgaggcttcccgcagctggggtggaatatggcagcctctgctactctgcctgggagtgcagaggaagcttccatgatccctcaggaactccagactcttagtccagtcagccatgtaccttccggcctgaaaacaagccctctgagagctgtcttccccaggattttctgctgatctcttgcaacttgctcctcaaacccaccctgaactctgactggattagaatcccagcaagggtcctgggcacctggctgtgtcctatttagaaagggctgagtcaggcgaacttataagcagaggcaatgtcccagagggtggcagggtggaagcgctgaggggagacctggggaggggaaggcaggcctgtgaatttggtgggtcttggtttgaaggtgaaagatcaatagcagtctgggggtgggaggagggtgtgatggttaattccatgtgccatctcgactgggccatggggtgcccagacatttggccaaacattgttccaggtatgtctgtgggggtgtttctgggtgagatgaacatttggatcagtagacttaaagcagattaccctccctaacatgggagagcttcatccaatctactgaagacctgaatagaatgaaaaggctgagtgggaggaaactcctcctgcctgactgcttgagctgggacattggtcttttcctgcctttgcaccagaatgaaacatcggctcttcttgggtctcaagcctacccacttgcagaatggaacttataccattggctttcctgggcctcaggccttcagactcagactagaaatacacatgggctctcctggatctccagcttgctgacagcagatcataggacttctcagcccccataagcacatgagctaattatttacaataagtctcttcctatgtctatatctacatttatctctatgcctatcatattgattttggttctctagagaacccttatagatgtctaaatcaggacttccctcagataccaggaggaccccatattcctttttggggtctcacatctccaacaactctgaagtaagtgagcatttccttcttcctcatagctagcagaggcctcactccctgggagggcctctttgcagatgggcagaagccgtcagtcctctgtggactcctagcactcaatatgggtcctggcacccagtaggtgcacagtgatattgactgaacgaatgcatacctcacacttatttgggtagccctttatggtttggggcataatcacacccatgtcctcatgggtgtgatcccaaggctctgtgaggggcagggcagggaccatcagccccagttaatagatgagcaaacagaggcccagagaggacctagaagcagttccagcagaaggaccctatctccagggcattggctttctctggagcagccatggcccatgtttagcaaaaacaggatgctgccctgagcccaggtgcctccatcccccctgaattcatgcactctgtaacacatgttcagccactattggctgggccctgttctagggacttagagtgcatcagtgaacaaaatgaacaaaaatctctgccccatggaacttatgttctaggggaaagagacagacagtaaacaagaaacagaataagtaagtaaactatagagcatattagcaggaggtatggactatggcaacaaggcagaacagagtaagggaaccaggaatgcaggggtgggagatgagtcacaagtttaaatagggtggttagagtcagcctcattgagaaggtggcatttgagcagcaacttgaagcaggggaagaattaagccacgcagttactaggaaaggcctttataggcaaaggggcaaccagtgcaaaggccctgcgtcgggcatattacacagggcctggcaggccaccgtgagagctgtggctttcagagagataaaagaaggcccacacagaggcctccaacagattctacccttcctggagtgtggggcctgctcaggcagataataggagagccagaggatgcctgaatggaggtgggaacggtagacaaagaagaggtgggaagaaattttccctgattatcatccctttctgcttcaaccagacacccccaagcaaaggcagctcctgcgggtgggggacaggcccctccccaccctgcctctcctaagcctccctctcaggggacttgtgaggagttaatgaagttgagcccaggaaagcaccacaggtagactgtagaacgctgggcccccagctggctatcaccatcactgcccagcctcgacagggaggcaggggcttcgcctttcctctgctacacactggcagatgcaagaagcagatccgctccgaagcctagatgaagtcgcagttagcagcctaattttagactgagcatctgctcttccgtcccagagatgcagctctgtctgggatttgctccttctggaattgccggagaaacgaatcctgctctcgggggcaggcactggtggtgtccagatcagagctgaccaataggccctgccatggggaaggcctcaggagctgtgccaccctggccatcctgtgtcctcctagctgagctcccatctcacactgacatctacagagtcctatagcttccatcttggagtcccactctgccttctcagaaagccacaggtcaaatgaggctccgcctcacgcagaacaggggacctcctggacaggagtggcttttatccatccccacacccacagctcccagcgcagaccccgaagaattcatcccaggtgagtacggcccagtcagactaagactaggagagcacaaaggaaggaccagttgtttgcaaatcttcccaggaaagcttgtcagaggagatgagttttgagttggattttgaagagtgggtaggtatttatcagtggaaaagccaggaaaagctatggaggcaggggaaacagctgaaaagaatatgaaagttggagaatggcctgaagggagggagaagaaagtggggagaccctggtggggattgggcaggggctgggtgcagttgagttgggccacaactccaggctaagcagttggggttgtatctgcaggtgggagagtctatgggggcccttagcgcatgagtgtgctctgacagatggctgtggaagacttccaggtgggaagcccatgcccctctcacctgggagagccactttccctgttgacttcctccatggtttgccaggtcctttggggccctccccacctccctggcacatgtggggcaggccccatgtgcagagtacactgtggatactcactcccctcccagacccccacctgagctctgcccacacatctcctggcatcaggcccatcacctcccacccttctgaccgctgcagccactgcttggtccttgtctgaatccccagttcccatgggcagtgttcttttgcttctccggcctcagcttctctgccctggggctgttatctcaagattcctcaagaatgactctgcagtcccacgtgcctctccctacctttctgtttgtgggcggcaagccctgttctctgagctaaggactttctacacatcaccttgctttatcccccaacaatcctggaagatgtttattatttatccctttttacaggtgaagaaaagggtttgatgagcttaatttgtgattgatcacacagccaggaagtggtagagtggaggccgtctgcctctcagtcctctcccaccaggttcccccagccttgagggcagggcttgagcagtgatgcccaggccagaggcagtcaagacatctggccagttcaggtggggagtgaggagagtgaaagaggaggaagactcagccagggaccatgcctggattcccttgagaaagaatgagttaaacacttacgtaaagagatttgcaaatagattctacaaaacaacatttggatgatttaagtgttaaggaatcagaaccatatggattaaatgtccctgacgttacgtatggttttaaaaattagaaggaaatgtaccgggaatatacacatgtataaaatatgtaaagccaggccacatttttagctttgtggacatggagttatttgaaaaatacggcacagcttctcccaggctggcggtccccctgccccctccccaggccttgtcttctcccccaccaaatggggctcagctccctccctaggggcccagcctgagaaagagacttcctggaacagccggctagctgctctaaccacaggacagttggagccaaacagctgggtcaggaacgactggggtctcccagaggccagatgggtggtctcaggtgcaaagaggcagtgagagaatgcaagtttcccaggaggacctttaagtactttatagagaagatgttgagtagctcaggagaggcagacagcattttcagttcattattgcttttgaacctcactcagtttccccagcagccacaggaggaaaaggttattacccccatttcataggaggggaggctgaggctgaggagggctggctgctcggcttagcttacaggcagtgcaccagaccacgacctggatttcctggttacacacccagagcttctcctcactgtatctcactgcttgaaacaaaccaaaaccgcgagcctgagtccaatttcttgaactctaagcattttttttctttcaagattgtgttagcttctcaagcttgaaggtttatctggcagggtatttttgaggactccctaagtatgaataaatcaagtttggttgtgagtctaaattgcacatgctgttgagctagggaagaagggataaaatgttcagtttgggaaaaaccaaaccatcagaaatttcctggccaagtcctggtggtgaagagagaggatgagaacaaaaagccagttcgttaaaagcatcacgttaggtgccaggagtgtgggacctccctgaacccccaccccagcccgtgcagaaggtggggttgtctttcttctgcagaaaaggaaacaggcacagagagctttgatgatgcacagctgcgtttctaacccctgcctctctgacaccagggcggggcatttccctaaacccagctggctggggccgacctccccagaggggcttgtcagatgaagccagaagcaggtttgtcaggagaattgaatgtcacccagacataatccccgtgtcgggaaagctggccctgagtctgtctcatgccccgccaggtctccaatgcccagtccagtgcctgatgtttgttaaatgatcattaaacaaatcaatgggtgaagaggaaggaggcatcaaggaaccactacatcctccccttctctttcttccattccccacccatgccactgttttgtggacacaagggatggccttcccacgaatgtattcattctggcgatgcttcatcctgttcagtggcattcatgcttacagcctgtccagagctctcagggtgctgactggaacctggagtatttcaaggacgtgggattctcagggcaggaaccaggggaaaaggagaaagggcagaggaatgaggacagagaaggtgagagactcccagctctggaacttcctccctgccccgtacccaggacccctccgtagagtttgcagtagatctgcccgtcgatgggtttcctataatggcctattcacaggtgtcctttgtccagggttatcccagccccacccggctgccggccaccaggatggaatcctcacgctgagatcacatccagccgcctttccacacaagcacctctgaggagtccctttgtctgcagcctttcccatggtcaattacgttgggaaaacactgcctattccacagtcaccttggagctccccagtgtacacagcaatgcacaaagccctgagaggggcgggtaaagaaaacagctcatctttagtccacacttattggaacagaacagggactccccttttcccccacacaggtcccatcctctgcaccccattttcacagccatggaattcttaaaatgctggcacaggcagcctagaaagcccctcagaggccttctgctggcttctcatttatagaaccatcctcccatgggtgtccctgtccccccacaggtaccccaaatgtccttgactccaggctttaatccgtacccctgtgtgccccatgcctgtcctgcttaaatcctctcaatggcttccttctgctattaagacaaaggccaaattcttccacatggtgtccaaggcctgcttcagtgaccccacctgcccctcctgccacatctccccctcgatccacctggggcgtagggtcttctttcggtgccccctgcctcagggcctttgtacatgctgtgtctgtgcctgggacactctgctcgtacatcccttccacatccagcggactcctcttcaacctttccatttccccttgcatgtcacctcctcagggaagccctcccctgcccccaactaaaccaggccctgtgcacattccccagcaccaggcatctcctctccagagcctctcaagtagcagcatttgtaacttttatttatgtgtgcagtcttgtcagatgagagtgacatgtatgttttgctcaccatggaatctccagaaactgtcagagtagctgtgacccacatggattgtttctcaatgctgagccctgggatcagagaactgatcaccctgtgaggttagtactgaggtgctgtctccactcagagcctgctgagccctaggaagaccaggagagtttaccactcatcgtgaattccctgcacctggcatagaatatgattcaaactcagccctcaatatgggtgtagaggaaagtgtgcaggggtggtgggtgagcccatgggaaggagaaccaggccacaggctctgctgatgattgcggctccagggtgtgtccacacggcccagctcagacacataatgttatggagctgaggtgacataggatcttggggaccggggacaggacagctggggaactgccaatggccgggcaacatctaatgccacatcaccccgcttcccctcgaccagctctgccaaccaggtgtttcttttcttttctttctttttttttttgacggagtcttgctctgtccctcaggttggagtgcagtggcaccatctcggctcactgcaacctccgcctcccaggctcaactgattctcctgccttaacctccccagtagctgggattacaggaatgtgccaccatgccccactaatttttgtatttttagtagagacggggtttcaccatggtggccaggctggtcttgaactcctgacctcgtgatccatctgccttggcctctgaaagtgctgggattacaggcgtgagccaccgtgcccggcaactaggtgtttctcagcactccctgaggcctgggtgaggctggggatggcggggacagtttcctccccatgcaggagaaggtggaagaacaggggagtcagactccagcccaatgtctcagaaattcactgtgggagcatggcagggtcacacaatgcttccgagcctcagtttccctatctgtaagatttaagggataagccaatatagaatgatttacatattttgcctcacattattactgactcagcgctttcatccatctcagggtaatgcacgaccattccttttctttctctgttcagtatcctctctcccctttcttctggcaagaattcctcaggaaactgccccccaactccactctcaattcaggcagggcttcccttcacaggaggccaccatcctggccagggcagggaggggcaacctgtttggccaaacacaatcgcgcagtgacccaggagtagtcatgtggcccaagacgggccaatcacagcacctccctaggatttttcaccctgcaacagctgggaggaaagtccacttttcattctggagtcaccagctgggatggtgaaggctagggagccagcaggggccatggcccttctccaccctgcagagtcactgtgttatgccgtgtggaggatgacgcccaaaagcagcagatgagactgagatcaacacgaaaaggagtaaagatgaaaagaatggggaaaataagagtctggtgatctgatgacattatatcagctcctggatctagccatgcctgagctccaccacctactcatccctataaaatgagacaatgagacaaaactcagtttctctcttcccaccccaactctcacttttaaacaatctctgaaaaggcaggaggaatgaaaatgagcatgcactgagagccatgcactgctctaacacgcttcacacgtataatccggtctaatcctcatgacaagcctatgtcgtaagagagaaatacaatagtgtgacagaagacaatggatgctagaaaagggtgttaaagacctgagctctaatcttagctctgccgtgcaccagcggtgtgacattgagtcagttccttaacttctctgggcttatctttgcttcactataaaatggggtagtgatgcctacctcaaaggccatcaggagaatgatgagacaaaacaaatgaaagagcctagaatgttcttggctaggagaactttaatacgtgttagttgagcctgtgaagtccagaagccctacagctagtcttgtttctaagaattagtgttggccatggggaaaagaagagaggaatgtgtgacaagctcccagctaaagtccaatatctggttaatatccagcattggcctgtaactatcaaatctccgatgacgtgaggttggctgatgcgtctgcttccccgcacatcgggcggtcaggtgagtccgcaggaacaacagttctggtgagtggtgatgggtcaccaaggaaaggggcctgttaatagtttccagatgggcctaagctgcttccagtctcccctgcacagtgttgaaaagatgggctaggactctgaacaaagctgaacttgacctggaggccccagctaatgggttattggctctattgggttggggacagggcatgcctctctgtgctgggctgtctgagaggttggcccatttgtgtcaccttctggagagcaattctaaaaaaatgctgctctgaataaatattttggttccattttgcgacgtggctgttggggagatttccatcgagtgtggtttgcaaggcgattctcctctgttgtttactctcggcgatccccacagcctgttcctggcagcatctgcatctgctgcactcctgggccgctgggacctggatgctccgctccagagagaggctgagttggccggcccctccattgggagcctgattgcgacaatgcattaggcagctggccaccagacccacagggcctccccactcctcagcttaaccttgctctccttagccagctctggctaaggctggtgctcttttagaagtcccattcccaccaacaaggaggaggctgtaattagcccagctgctctaggccaggggcttggaattcctgtgggcctagagaagcagccttgtccatttcctcttcccaggggtggcctccggctcgcgctcctctccacccacacacctcttccccagaaccacaaccacacagcagcaggcactatccagtctgagcagtaccactgtctcccacccatcccccacacatcaaagcaacttggagagaaaccccagcccccttgggcctgagcccaccacacctcttggttacagtgactgtgacgactgccctacccgcttgaggccaggtccccagggctgccaaggctcagcatgcccagccctgctcagatgatgacagctctccagccaggaggccacacctcatctcaaagaggaagcagttagaggtgggagccttaagcacactttcaagccagctcatcttagactctgctccctatcaccatggccagatgtccagggagaagaaggattcatggggtcagggtctggcaatcaagacagagaaatggcacaaagtagggagggtgctttccaggcatagagtttggtgtcccagtacaggacccatggcccagggagaaggtgctccacaagggatacatctcaaggatcctgggtgggaggactcatatcacgactgggcatttggaatgttcaagacccttgccatggaggcagaggctggcacacactgttctttctccctcccttttcttctcacctccccaaagccactcccctactctttttgacatgcgtccaattctggtggctcaagttttcatgatgcaggccttctgggaccctattttgcagatgaggaagctgaaactcccagaggccaaggtccatgcccagggtcacagagcaagcaaggcagagccttgatttgggcccatttgtcagaatccaaatccagcactcattccatggcaccatggctgcctctgaacatagaaaggacagatcctatctccccagttgggtgcgtgggactcatttgcctatacctgcaatggaagctgctagtccctccctagcctcactcagtggtccagagaccagttgcatgcatttggggaggggactggtggcagggatggaggactgctttggtatggaggggagctgaccagcctacaaggtgctgctgcccagctgtggctctgctggcaccatgtagaccagcagtgtccctccttctcccaagctctgcttggctccagactctcagctcagtgcctgaaggctcagccctgcccatcactgaattcagcctgcccagacctgggaggatgtgggaaacccagttccatctagggctagaattaattttctcaccagaagccacatgccttgtggatgctctgggcttgcctctactcgcttgccacagtcttctcctagtgcccttgggaggcagggcatctatctggaggtctgacttgagctcaatcctgctgccttaatgagaacttcaggtccactttgctaagggtctttgcaggacacctgtctggctccacagccacccactccatgactataccctgtgcctcatccttttagcaaccaagttttggatcctgccctgaaggggagatgggccaggatggttgagcctccttctaagagacactggctctcacacctcaggcacacactggtccctgggatgaccatgtgggccagacagctaaggatgtgacatagtcatttctctacaggtcacgttggcaaccaggcctgacattgggccactcctctcaggccaagcagctgagacccctgggctccatcagtactgagcatgtccaaggtatctaagaggataccttagattctggccttgtcctcaaatgccaattatcttcttcctgtccaaactcttactctggcagggagtcactcagagtgctaaaacagtgggaaggattgggggcagtaagcttcaaccagaaagatcacttacaggttcttagcctcatcacagtgtccagctaggtggggatcagcctatagttccaaggccatagtcccacttgcttctttttgaaccagctgatagctgtctcagtcccactcagggcaggaacattgtcttttatgctggtgctggaaacacaaaccacacctctgcatggaaactgccctgtgctctgctctgtgattctcatgctggcatcccaaatcttttaaagcagaatgtggagttcctaatcaaccggcatcaagtttcagtgaagccagatgaagcagctctggcgatctgccgcacaatgttgtattaatacctgtcgtctacaacaacgtattgtacacttgaaattttgttaagagggtagacctcaagtgttcttgctaaaataaaataaaacggtatatggcatataaatcaaacaggacaaccccctctccgtggaagcttttatgaaaataatcacagctaccacttactgagtacttgctatgtgccatgatctgggctgaccatttcacatttatttaagcctcacaataataatccctggagggggtattaatactattcccaatttgcagatgagaaaactgaggctcaaagtccatcctattccaaagctcttatcattccccagaagctaagaactggtgtgtgtgtgtgtgtgtgtgtgtgtgtgtgtatagacagagactgtctgctggagtgcagtggcacaatcacagctcactgaaacctcaaactccttggttcaaggggttgtcctgcttcagcctcctgagtagctgggactacaggtgtgcatcgccatgcccagctaatttttatatcttctgtagagacagcatcttgctttgttacccaggctagtcttgaactcctgagctcaagtaatcctcccgtcttagcctcacaaagtgctgggattgcatccgtgcagcaccgtgctgagcctgatctgtgtgttttatcaatgggctttggagatggttcttgagggccaggggtgactcacagttgaactaaaatgagatgtgccctctccccggcagaacatactaaagtgctcagctggtgctcacgtggctgcaggcctcctgcctgtgtgatcccagggttagtttgtgagccacagaggacaaggcacccttgcaccacattctttcacaggcacagctctcggggcacacatcctctgggccagaatggtgcagcgctggcctggcccctctctccttgcttccccagagaccatcctaatgggatgggcaagtgatccagtgggctggtggcacctgagggaggaggggctgggagggaaaccttgtgttcagctacataagttccactgccacaaccttgtgactatgtcccctcctcctgatatggactggctgccccaacttggatgttctttctgactatgtgcaaattccgattcatttacaaatctgctcccagctcccctctgggaatggtgaagccctgctcaggcacatccctccttcctctaacgctatccctgatgacatttccctggctattacataatcaagggagctcagccaggactttaattggaaaagctcttccccaagggtctccgcggatatcacttgtgccagcccaagccctcttacctctcaactcctctctgtggtctctttctctctctctctctcatacgcacacagggacacgcagctgaggccacatcttctgtgcctgtccttggccacactcagtggcttgcatgcttggtgctcactgtgaactatgctgccctgggtctttcaggcccatccccaccaggaagtcttctctgagcacctccacaggtggctcagggctggcctcctcctggcttccgtggcactctgtgcttatggcattgctgtggatgtgtctgtctccctacctaggtcgtgagctctcaagggtaggcaccaagcctgattcttccctgtgctcccagcccctgaattggcccagccccaagcaggctctgggagggttgatggaacgggtcagtgaagcagagggaggaccccgccgaataccctgtggttggtgtcttggggagctctgcattagctgccttacagactttccagaaacaccaagaaataccagctctagacaaaccaaagaaatgaatccagttttcagagtggaaactgacgcccagccggggacaggtggtgcctagggatgcaggacctcttggtggtagagaagtcttaagggggctcagtgcaaactcccttaggcctctccaccctcctgctgcctctgagacctcagtaagagcctgcggaagctcactcagggctgtgctctgggggactcatttctattccttccaatagacaccttccaggccctgggcttggcctgggacttagtcctggtgctcacggagccgtacagacatggaccaaaagagctgcaaagcggggtgaaaatctaataacagaaatgtgcacaaaagtgccaccacggaagatgggggaggtcaggggagacaccatggaaggaatgacatctaaactgggtcttaaatgagagtttacaagaggactaagtggagatgggagatgagaggaagtgggtggttcagtgaaagagaaatgtgcaaagacagagaaacatgaaacaacacagcaaaatggggatctgcccaagccaagtggtggggctgaagcccccaaaacagaagggaacctgcactttaaggctgaagcagtgggcaaggccacatcaagaaggacttgaaagctacactaagccaactggaccccagctggtaggaaaagagccttatatttgcagtccgtgtgcctcatgcagagctcccttccaccaaccccaaagtgggaaaaggcactggcatatgacataatcctattctatcccttacccaggcaaccccctaggccctgtaacaaacacttcaccactgatgggaactcctcttagccacagacatccttgcatctcagagctggagctgtgaagtgctaacaattaatcattgcagagatgagttcacggtgacttcagaatatggagtccttagggataagttttataaacaggtttggaacttcagcaaaaacagcttctcttgagtctgagtaaaggaaagggttattgcctggctcagggctggtatggccatggctggaggctgggaggaagcccacaatggctgtgtgttttcccgtgagattttacctacactgaaaatcctggagcatcttcttggactctcactagggcccaggactcagtaaaaattcaagagcatgagtcaaagcagcctggcagaggatagagctaagttagaagaggctcaggacctggaggcagccctctgtggtgctgcccctcactgccatctctataccagcacttcgaggttcttcccatcaccaccctcctggtcctatcactgctggtgaccctcataacccatggaggaactcagcaagttgtgtggggtgcagggtgttgctacagagctcagatgactatcagttcctaattggttagcagctgtgtggtcctttgtcctgtcttccaaaagcactgcctttaaaaaagacctttgcctgaccttgagatcaagtctgctcttttgacaaatgtggaaactgagccccagcaaggggaagtggttaacccagggtcatgaggggaggtggggacaggggtgcgggaggacccaggtctcctcactgtctgcctcaccactctgacttcctggaggtgactcagcgagacaagcagcagaggaaggaagtgggaaagggaagcccagcctgctggattccaggtcaccactttgttagtccaaagccaccaaccaccttggccatgcagctctgcctggtgccagtgaccttccagcccttccttcccaaggctgcagctgctgaccatttcctccaaggccaagctcacatggcctctccagggtctccagcgactccctgctgtacagtcccatggtgctgccctcctgctggggtcaggagtcacctccatagacctggcatctggctgaacctgtgcaggccgaaggttcatcagtgagatgagaggaggtgtaattactgcctcatgtttaatagctgggctctggggcctgttttcagttttcatcacttgctggccatgggtgctttgatcaacctccctgaactcagtttctttaatctgtaaaatgagattacatgcaacagtatctactttgtaggttgcttgcaggattagatgagataatggccagccgcagaccatgaacttaagacacattggctcttgacatcattgactatgctaggtgtgtttacatgcatcctctcatttaatcttcacaacaacctgccaggtggataccattattctctttcactggtgaggtgagggcacacagctcatggccagacgtgaacctggttctgtctgattccagagcctaaatattctcctaccagctacagaaccttctcttactgttatatggtcaagtgcctgtttttgccctatcaccacgtgcttgtgtggacagggcctcttctccttctccctggattccagtcctggctctgacacttctcaggaatgagacttgtctctgagcccccactgtcccatccatacactgaaaaattggcactcccccagccttcttcttggaggaacacacaagaggacggatgtgatggtgttttgcaaactgtaccttgctgtttgaatgcaaggtgctactcccccaaacagaaatgcttttgggactgttgcgagtgcagcctgagggcagagatccaggaggaccagggcctgtaggagtacctgccttggccaccacaggaattgctgcaggtcccttcagtttgtggctttctatatgttgagagcaggtccttgagagcaaggcggggaggctgcagatacagtacaagtctttgtttccttgcctgtttcctccactgcactgtaagttcctcaagggaactggactggctcacagcacatcccttggatggatggcattcacccccctctccagccacatgggctcctgggagctcaccaagtgggccatgctgctttgcccccatgcccagctcaactccccacgggaagagatcatctttctctcatgaacccaggtccccacctcaactgtagcacttactatatcacaaacccgatttctaccttgaatcctttttggaacagagtcagggtttgaataaataaatatacttgaacttatttgttttctgtctgtttcttttgctggattgtaagttccctaaggcaccttctgtgtgatactcatctttgtaactctcaataaccagcaccaggaacctttggggtatgtgtagcatggttctctctccaacccgcctctctgtcttgcaaactccccctctctcaggggctggtgtgtgttggaactgtgtgtaacagtggaaacaacaggcaccagtggatctgaccagcaaatggactggcttatcatttgggggttgcctcatgtcttgatgaattctgggtttacttttgggttctagactgtggtttttttgtttgtttgtttgtttgttttgttttgttttgttttgttttttttgagatggagtctcactctgtcacccaggctggagtgcagtggtgcaatctcagcccactacaacctctacctcctgggttcaggagattctcatgcctcagtctcccgagtagctgggactacaggcacacaccaccacgccaggctaattcttttgtatttttagtagagatggggtttcaccatgttggccaggctggtctcgaattcctgggctcaagtgatcctcccaccttggcctcccaaagtgctgggattacaggcatgagccaccacacccggccatagactgtattttcaaagtcaccacttaagtaatctcctccagaacaatgggcccatcgatgttcaagatacacaatggggagaaagcaaggagtaggaatccatcaaaagccccgtacagttgtcttcttttctccttgactttgccgttgatgagtttacatgcctgaccacttccaggacatatcaagcctggacatagctggattgtgagagtgtgctgtgtacttctaagtactgactggaaccatgcaaaagcccagcctcttttatgggtcaaggagtcctggtgaagacagtatcaagccttctgggggtggggatggagtataaacagacagcagttctgagaccccagaacccaggaagcagttctagctgctatgagtccctggttctcatctgtgaaaagggagaataataaaatccaccctgcagagttatcagaggagcagcatgagattacaatatataaacacaggagcatggtaagaatggattcattcactccacaaataatcatttagcatctactatggaccaggccctggtccaggcactgggcacaatatacagccagtggcatgtgggctggtcctgagtgctatcaagaaaggtgaagcagaaaaagggaacacggaatgggggtggtggcagtaggaggtgctgccatgttaagtaggggaccagagaaggcttcactgagaaagggacatttaagtaaagacccaaaggaagtgagggatgggccatgtgcatatgcttcctaacagaggaaacagtaagtgcaaaggccctgaggccagagtttgtagaacagtacacagtccagaggatatgggggcaagaaaatcactggggctgtgaaggcatttatgcaacttctgaatttcactcagagacaggaagctatggggggttttccagccaagatgacataacctgacttttagagctaatcactaaactttagctgccccttctcttcaaagcctcatttaatatccagacctctgcaactccagcctatgtgcctctcctttctcagatttcttccagctttccacatctctccaaaccaagagggcttcatcatgctctgccacatgcaggctggagagggacctcgcagagaggctgtagttgggaagggagagaaacagagcagtcttaggtaatggatcttgctctcctctctctgtgctctgaaggcctctgggcctggcccagctgcagcaaacgcacacacttaggtgcacggcgatgctgggagcaatgacagagtccccggtgccccttcatcatctgagaaagctcagtgcagaactgggaatttcactccatgctccctcaccctgcttatctaccaaaaggtgaaatcatttgttttaaaataaaacaattcccatatctgtcagtggtttttaaccttttttgggtcactggctcctttgagaatctgctgaaagctatgagctatcagaaaatgaacatgagatatgtactcattttcttatcattttaggggtttcacagatccttgaaaattcagtgaagaaaccattatctaagccaacaatttcccagccacagctccagatgaatgaatgaatgaatgaacaaataaataaagaggctgagtgcagatggaggaacgatgggggatgaacagagcagaaagatgcatgtgcctgtgggcaccacggttcttgttgatagttcctgacaccttcaaagaagccaactgggaagtgatatggggtcagggtgtgcttgacaggtgacctccagatagccaagccgatcttcttcagttcctctcgtctgaccccttctgttgttctcctctgaccccttctgttgctctcctctggcccctctgggtgactatcgtcctaaaaggtatcaaagcacacttccctgtctttctcagggtgtcctgaacaaaacaggactcttttcctggatggctatggggcaagagaatgaacgtaaattcagatgtataaaatgtaagcaatcactttttctggtcatatggctgacctggctgaggcccagagcccccacatcggtccctccccagccctctttctgggatccaggtttctggcctcccagttcattttaatttttgatacatctccagggaaggtggaatgaacacttaactcattcttaaagtcacaactcccactgtgaaacttttaacacaatctcatttttttctaatcattgttctacactgtaacatagggagaccttaggtggactagggtgggtaggaatccgtccaaacacacaatggtcccagggaactcttctgacagagaagcacctccaaggccccggtgatgtggctccgccacctctcctctgatcattctgcctcctcctcggcaccatgctccagacatcctgagctgggagttccccaaacggatctgttttttttttttgcctctgttgcttcatgtgtgctgtgctggccacctggaacacaggccaccacctgcttgtctcacaagaaagctcttacctctctgctcaagctcacctcccagcctcctcagagagcccatttccttcccctgggaatcccgcgtcctcaccttaacctcagcacttaggacactgtatttccaacttctaaaaaaaatctttttgggagaataaagttacagtttagagaaagacacttacaagtgtttacttaccgattcatttcatgaactgagtcttatttatctttgtttccccagcaaacagcacaaggtacgtattgatgtttccgtaggtatttgcaaataaatgttttcctggtagagtggttctctctctacccttccagctagattgtctgttgtgacctcaaccccctgctggtagggtcccacctttcactggcctccctcggcctccacagggcacctgttagaactgtgtgcaaaccacgagggaataggcgctgaggggctctctcgggagtgaactcgccaacttagtgtttggaggttgtgcctcaagttacggctgccctggtgagtctgtgctttctgggatccgggtgggtagggtcactggtggggaaacctcctccagcaagttgtcatagtaaccaggactttccatttcacgggagagagtccctgggaggaaaaacacaccaagggcttgggaggagtggtaggaagccatgaaaagccttctgacactgtcctcctgtaccctttgctttgcttcctactggtttacatgctcaaggtagaggccattatgtgtgggcatctgagtagaagctgctgaaaatagccgcccgactatttcagggagcagctgaatatgcatgaagctattttagaaaagatgtccctggcccagctaatccaaaccccatcctttcccttagaagtgccaagacaagttgaatgggacctttcttagtctttcccactagggtgggggtgcttcagaagccacagaaacaacaccctggctaatgttggccttgcagcctgtcggctccgcctcccagtcccgtggtcacagaggcttctagccagacagctcagccttccacggtcctccggggccttggcagccttcaacaactactttgccacaatcccgtgtgcctaggtccttgggagtctcagatcttagatatttccacatttgttcatttattcattcaatacacttgtattgctggataacatgtgtgaggattgttttgggtgctgggaaaaaatggtttctgacaccagcttatggcaggggagtgtggacaggtgagtagaaagacaataaccataaagttccaaaacagagaggaatcaggtgttgggaggttggggaaggagcccatgcttcttcctgatggctggagaaagaagatggcatttgagctgagccttgtctgagaaacatggctggctcaaggggcaggggatggctgggtgtggcaggggcaccctggtggaagggtgtgcctgacaggaagtgagaaagaagggcaggagattgtggggacactgaatgctgggctagcaatgccttctctgagtcctcaggctgggatggggagcaccccgcttccacgagcctgaagtgcctggtgcacccttgccactgccttcaacctagaccggaagtgccttgggccaggagcctggtcagatcctcctgagcatctccagagccctgtgccaggcttgggactgagtacacttacatattgttggctgaaagcatggattctggcccggcacggtggcttacacctgtaatcccagcactttgggaggccgaggcagatggatcacctgaggtcgggagttcgagaccagcctggccaacatggtgaaacgctgtctctactaaaaatacaaaaattagccaggcatggtggtgggcacctgtaatcccagctactcgggaggctgaggcaggagaatcgcttgaacccaggaggaggaggttgcaatgagccgagatcgctccattgcactccagcctgggtgacaagagtgaaactccatctcaaaaacaaaaacaaacaaaaaaaagaaagcatggattttggagccagacttcctgggttcaaatctgggctctgccccttactcactgtgaccttgggcaagttatctgacctctctttgcctcggctataaaatggggataatactagagtctatctcatggagcttcttggtgaaaagactccattacatgaattaatatatgtcaagggcttagaagtctgtgtggcacatagcaagcaatacataaaagtgttaactatattattctaaagaatatggatttttatcttgaaatggagtgccatcaataacaagttttccttctaaattgaaaatagctttattgctttgactgatcatatcatatgtacctactgtaaaaagttaaagcattatcagtataaagaagaagagaaaaaaatcctccccttaaatcctgactcagataactactgacatgaccatctgctatggcctgaatgtatgtatccctccaaaattcatatgttgaaatcctgaccatcaaggtgatagtattaggaggtggggcctttgggaggtgattaggttctggggacagaatcttcatgaacgggattagtgcccttataaaagaggccaaagaaagacttctcatcctctctaccatttgagaacacagcaaaaaggtaacacctatgaatcagacagtagagcctcatcagatcacgaatctgccttgatcttgaatttcccagccttgagaactgtaagaaatagatttctgtttttctaagccactcagtttatggtattttgttatagcagcctgaatgaatgaagacactatctttttagatacagttgatcctctttattcatagattctgtatttgcaaatttatgtacttgatcaaatttatttgtaacctccaaatcaatacttacattcatagtcacttgtgggtgtgcagagtggtgaattttttttttttttttgagatggagtctcattgtatctgtaacctccgcctcccgggttcaagtgattctcctgcctcagcctttcgagtagctgggattacaggcctgcgccaccatgcccagataatttttgtattttagtagagacacggtttcaccatgttggccaggctggtcttgaactcctgacctcaagtgatccacctgtctcagcctcccaaagtgctgggattacaggcgcgagccactgcgcccagtgtggtgaaaattttgagttgcctaatgtgcgtgttcccagatgaggctgaatgaggcgaccttctgccttctagtttcagatcccatatggtaaacaagtgtccacgaaaaggacactatggacagttttcgcagttttgcactttttgtttggtgattttactttttcaaatggcctccaagtacagtgctgaagtgctttctggtgttcccaagcacaggggagctactgtgtgccttacagaggaaatgccatgttaggtaagctttgttcagagaggagttatagcgccactggccctgagttcaatattaatgaatcaacaatctatgttaaataaggtatcttaaaacagaaatacacataacacaaggttatacactgatcagctgagaaaaacattgtaaccagaggctcacaggaatcttatgctgtagttctcctaggagcaacagttcagtatttgctaattctgtgtttgtgaggactttatagaacataactactatgaataacaagaatcagtgacatctttctatatatatggatgtacgcttctgtgcaatttggaatggacgttccatacccttttgatactttaaaaaatcatgttaatatgtcaaaggcatctttccattttcataaatacaggtcctcagatggctgcatcactgtgcacgtctctgtaatgaataaccagtagctccctattgatggacaatttggttgcttcccattatttgctattacaaacaatactatgatgaacatccttattggtaataataaaagagctagcatttattcagcacttagtaggggcccaaccctctgctaagagttttataagtgttatctcatttaagctttgccacaagcctatgaaagtggtattattatgcccactttgcagatgaggactttgatgcttagagatgttaaggaacttttccagggccaggtggcttgaaacaaggtctctctgatctcagactccacactcttaactaatgctctgctgctttcctacacacataaaccttgggcactttaggatacttgtttagaagtgaactactgagttgaaaggtggggacatttgaaagtatcaatatataatctcccctccagaaaatgtgtatcaattcgtgacccactaaacagtgctccagtgttcctgtttctcattctgcatttccccaagtattttcattctttgaaatggcccccaaaggacactttgattgtttaatgtgtctcctttgcccctgggtgatgactcttcacatgctttgtatcctctgtattttgtcatttatgaattgcttgttcatagcctctgcccatttttccgctggcaatttgtctttatctaatacttcacttacaagagctctttgggtattagtgctgctaaccttttacccatcatgcctatgttgaaatacttttcttagtttgttatcatcctttaacctgattgttgtggggtggggtgtttgcccatagggtttttaattgttttccttcacagtttctggatttgatattacacgtaaggaggcattcgtcattccggtatgacacaaatattccctcgttgtctttcttttagtatcattatggtttcatgttttttaatctccttggaatttattttggtgtaggaactgaggtagggagccagttgtattccctctcctccatacaaatagctcgttggttgtctttagaacacatcaggaatcacctgcattttcatctctaattatcaatgccatgcattcacataccaatcctcacgtacactgatatctacttctgggctctctgttccttgagccacaggtctatttctgtaccaacactgattttttttctaggccattcatccatgtttatttttccagatgtactttgtaaacattttatgaaaaattttttttgggatttcgagattcaattttatttatagaacaatttataataccttcttcagttgactcttcataattttatgcttttatttctttggagaatgaagtctttttccctctatgctttctaactgccttattttggtaccaccttcttgatgaaagcttttctactcagccctgcaagagtcttttctaatctctccccactcagcactcggccttttgcatgccccacccgacctttttacccaaaattataattactgcttagacagtgagctccttgaaggcaggttccttgcatggcctatttatacatttcctaccacacctggcaggttgtcggggctctggagatatttgccgggtgaatgaatgaatgaacaagtgaatgaaagacatcctcctggaaagctaattgtgaaatgaaacaaatcgattacaaaaaccctctttcataggctttcattagaaaacaaaatatttgtccttggctaaatctccaagaacgtgtcagaatgagagaagtggctcactactagactgcgtgtcatgtgcaacatgccccaacacctgtcctcagagactgccatcctcaccaagcaacagggcacttctcaggcaggctctcaggccctaaaaggcctccaggagaaggaacacaattattcaccatgtgcctgtcgctgagctagacttttaccaataagatacaacaccctgaaagttgggatcactagtctcattttgcaaatgaggaaactgagtctcagagagatgtaaccctacctagtaagtggtagggcctgctgaagtcagggctgtgggactctaaaaacctcgcctctcctataataacctccagaccaccagagtctgggaggttgaggggctgtggcccagaggggaatgctatacagagtcaaagagcaagggtcctgctgtcactaaaccaagacagtccctagaaaacttgtttcccccaaagctgtatgatgccgcttctataaatcattcctaaagagcttgggtcaaagagctactgtcaggcagggggcacatcacacaggcattattgttgctatgggactggggagtggaggtatgggggaggtggtggactcgccatggaggcggggtgttggtctccagtacctatctggagatggccctccagagtcctcctccttgcttgcccagggggttgtggcttttagacagccctgcagttccatcctgggagtgctgccaagcagccacttccttatcaggctggcagtagctgggcaggcctcagcttatttctaagtctggattagagctcaggtttctcatggaggaccatgggttgggggccaatacatttactggacttgactttgtgcctggcccagtgtaggccccagggacatggggatgagcagcctacaagcctcctgcttcatgcagctccattccaatcaggaggtgaatcacaaggaaaacccccaaccctgcccaagagccacagtagagatctctaatgctgagggtgcccagatttggggggtcagccggctgcagactgtggaggttggatgtcaggtgagggcatatgggcttcatcctgtgggcagagagaaatgccctacattctgaagcaagagcctgccatggttagatttgtgctttagaaacagaccaactaggtatattcgttttcaataaacgtgaattctttctcaggtgaaaattaaagtgtttccattttggacaaataatcccaacgtaaggaatcacagcagatggctatgggcctggatgagccacttacctatggggctgatgaatgggaagagccctgggcttggagtgagagacccacatccacggtcaagtccctgccaccatcttgctgtgtgacctccagcaaatgacttccccatctcaacctcggtttcctcatctatcagacaggaatactgccacctaatacacagggccgtcttcaggacaaaatggggtatcaaatggcactgtatatttgtacctacttgacaaatgtgaggcatgagggtgagactcctgaagaccagtccacacccctgagggcatttcagatgccccacagcctgcaatgtcttgggaagtctctctcagctgttccagctccagtcaaagactatcctgtcaaaacatgaccccatccagagaagcaatctcccgtgtgtttggtgggccacctgcccacggggcgcagcctgctgggccacgaacatcaacagcagccccttcctggtgggagaaggaacagggagctggcttgttctctaagagcacagtgctggcgggtgacgaggcacattttaaggtgggatgcttcttcctgcaccgttggcagctgtctacataaggtgcccattatgtgcaggccccaaggccagcgggcctgagaggccaagctaaaattactgtcagatgtgcacccgccagacacactgaacatctgaaggtcagatgcctccaagcagccacccgggcaggagcgtggcagatgggcaccaaacagctgtggcagctgctgcctcttgttcctcccaagcacagagacagacggccctgtgcagcagcctggttcaatagcccagcttgagttaaaaaatagaatgtagagtataatcctaatttaaaaaaaaaaatctgcgtaactgcatagaaaaaaaggtggaagaggaattcactaaatagcccagtcacggatgtggaatagtaggtgaattttttttcctctactttccaaaattttctcaatacatatgtattacttttgtaatcagaagaatacacaataagatgctatgttatatattcctatgaaatatataaaatgattaaatggcatatgctttgacatgtggtatatttgtgtgtgtgaatacatttatacggctggctggtattaaagatcaacattctccaaccccgcgttgcacagaagagacggaggccccaggaacaaagcaggaagcagagaggcagattttcactgaggctgctgttgcactggagtttccccaagccttgccccacttaattctgtagctggttttattcccacttgatggagatggaaaccgaggtacagagaagtgaactgattcactcaaagatgaccagctcggaagccatagagccaaatcccaaccctagctttccacccacagcgcactgagcttcaagaaaggaaaggcctttgaaaaaagaacagaacaaaacaacaacaaaaacaccctgctccttgaagtctcaaacattcagaaagcaactccttaagggagtgagttttgaattatttcctgagcccctccacgtgcacgcctttcttagctctgcggggctcatggtcatcttcccagagctacccatgggaacctttgagaggatgggtaacaaatcatgatgtgggggcacaaaaggcacagcaaatcccaaggtgggactggctggcaggtgtcaggcctttgggacagggtgagggagagcgagttggctggagaggctgctgtctaaactctcagtcttccagtgctttgggaggggcagcacccctctgcaacgccagatgccctgatctgaggcctttgctccagctcttccctctgcatgagtgccatctctatccccacatgctgccctcagtcttccagggcccagttcatccaggcatttgtgcattcttattggtgaacacattttaattgagggcctgctaggtgctagagcaaaagacatagtatcaaccctgtaggtgcctctagtgctcagagaaaggctacccagggtcattcaagcatagactctggggccagactgtctaggctcaccctggctaagccacttcacagccctgtgtgtttgggccagtcacagtctctctgtgcgtcagttgtcatctgtaaaagaggatgaaaagagcacctgcctcacagactagtgcaggtggagtgtacatctgtgtaaagctcttagagaacagtgcctggcatgtagtaagtgctcaataaacctcagttgctataaacattctcatcattaccctctggtgcagattccctccttatgatgcccaccctacttttgtcctctggctggtacctcctctatggtcccatagcactttgaacacccctccatgagagcactgatgggcatgcagtacaggtgtctgaggacctgttccctccttgtctctacctgggtagagactaagtttattcatctccatcccagcacccagcacagatgttataacatcaccaggtttatgtcagcatttgcaggtaatgtgtgccttcaattccagtcgagaaaagtcttagaggcattagaggttgtctatctggccttatcatgtagctcatccatgttgcccttgaactgtggggtctgaccctgggtgtgatctttccgatgagaaccaagttgatgagggagctgtgtgctaagcttccatgaatgcttctctgtgacagggagttctgctgggcaggacatcgaaaacaccaactactgacaccccaacacatcctggtgtttcccgtgccatgcctttctccactggggccccatgaccccactgctgatctaagaactcccatggatccttcgggtgccagtgctcctggccccaccccccacaatgcttctgctagccacagcccccactgaatgtagctccctctctcctggtcttctcttgtttctgccctgggcctgtggggctgctcctgctctcagtgtgtggctgttcctttgtctatgtgtcccttctggagaaggggcaaacttgctcttgtttgggcccccagtgtccaccaatgccaggatcagaggggtgtcaggaaagctctgctgagctcatttttcagaggaaagtcaagcccgctggcctgacctcccattaaggcacgcacgctgactgatcacaccaccttctgaacccaaaactcacaggtggctctaggccagccctgcccatcagttgccactcactccatcgcagggctgagtcagcagggaagccccgaaagtaagtgctgagcacgtggtgcataccgtgctggcctctcgcttgagctcttgcgtttgactctggcaccgctgcaggaggtgggtgttctatacagagaggccttcctgaggctctgatggttccaccgctcctcaaaggaggggcagggcagggttggagcaaggctctctttggccccagaacctactcattctacactcctgtgagacgacaggtgtgtgaaagtgttctgagttctaccaacggaggaaactgtaaaaccatagaattgccagctattacccaccacacagaaatcactctagtacaaccttgctatcaagaagaaggcttcaggggccttgggaacagcattgaatccttacagaattgctgcccaggagggggtggcctattgtccttcaggggtaggaaaggaggagagtgagtgggaactggaagagcagaagagaagcagtcctgtggctggagtggcagcccaacgcaggatggggccccggggacctgaaaggatgcagagggatgctggagtctgtgagagccgaggccacagacacttcagcacggggtgtcctgccctgggcccctattgaggttctgtagattctgacatgtgcacctcctctcatctcggcctccccaccactttcctccccaccctcccacaccccggtaggggcctctctcagaaccacagggctgactgtctcccttccctgcttgtgtaggacccagcctgagctcctgggtgaccagagtcctgccgctctcttggcctcactcccatactcctcctcttgggccctgcatcccagcgactccactgctccacttgctgtcccttgggctcagaatgctcttcttccatttttcacccggtgaacttctattcatccttcaaagcccagttcaagcgtcaactttaaattgtcttccttgaactacccccacaaccaaaccccgacagaatagagccctcctgccttcacaggttttgctgttctgtggctatttgcacatcgatctcctccactggagcagaagcttcttgaggataatgccatgatttgttcatctctgtgcctcagtgcccagcacagaggatagagcacaacaggcaataaatgatgtcctgatgacgaggtcatgagagggcaggcatggggctggtgattgcatctgagtttgacttccagcagcatttactaggagaaatacaggccccctccccaaaatgcacacgtacacatataaggtgaacacacagctcagtccaggatctctgtggctgtaaagtccatggagcaatcaaacaggagactgagttctaaggatgtggtacacagctgcagtgtcagccccactgtcctccccagagcccagggccttggcttgagccctgctgggttcaccgagtcccactccctcactttgcagacaaggaaacagagacccagaaaggagatgcttgcttaagattttcctgagcaataaaggcaggcctggggtcagaagcatttcccttggctcctggcccaggactctcccatcaccatatgctgccatttgcagaaatgccagctgcaggactcgtgacatttgggtggctttttcctaaagtgtcggtagcgtgtggggctccattctcctgcccgaggctaaggtcattcctgtctacctcctggcctcaaaacacagcctaatggcctttgggctgtgctgaaactgccctgtgtcctgtgggggatggggagggctcacctgccaaaaaccagccgtggtctcatggtcaagatgtgtcagagatttctagagcttggagaactgtgttggagggaggcctgtgggaagtagagaaagtgagaatattatgccaccgccatctgtcaactttcatctgagtttgaaaaaggcacccaaaaatggtgagcacagccttgctgaaagcaaagccccggccactaccccttctctaacatggttatgacgaggtcaagatcaggtccctgcggatgaaaccacagcctcaaaaccccagtacagagctgcaagtcacaagttgtctgccctgaggaaccccacaggtatgctggtcctgtactcaggcctaaggctggaggaactcccacttccaaacactcctcggggaaaacaccctttgtgggttccctaagcactgctcattgtaattcactcattcttgctttcattattcattcattcatgcaagcattcaacagccatttgggaaattgttaggtgttggtatcaggtcctcatagagatgaagtctctgagtgtgacagcctagatccagtaagaaaggcgtgtgtagacccaggacaaatgccacaggctggtgggttgcctcccttctccaagtgacctctgtgccaggtgctgggcaaagcactttggttaagctgtgcaggatggcagaatgtttctaccattttcggtacaaggacctctctttgtatgaaattatttctccaaactcctgatggtaactgtatacctattatcttctcattgagaaaataaacaatacaaaagttacaatgaactaatgctttacaattaacttgtattttagtaattatagcaccactacatatatttaaattaaggttggacacatactcatttgagacatattatttatgtcttctaggcttaaggctttgagcccttggggatccattcattcaatattcattcattcaacagacatttatggagcatctctgagatgcccagccctctggctcaaagattagggatcctggttcaagaaggagctccagctctgcagtgaggtacacttaagcttaagcccaggtaacactggatgtgtgcccttagggaggccatctggtcttcttccagctctgagtcctcaagagtaagatggagatgtaatcctgacattggaaagttgttacgaggagtaaatgagatagtagaaagcatccaggtaagggcctggcaccaagcagaagctcaacaaatgggcacccgaggattatcatcatcaccatcatccccaccaacatcaacatcattactatcaacaacagcagcagcagcagcaccaccaccatcttgcttcccttctcttactgaaccttgagaagcctttccttgtccctctactagggtatacagtagtttctaccttataatagagttatttgtatccacacttaaaataccttataatagagttatttgtatccacattttctttctttggttcatgcccagctctgtaatttcagagttgcgtgaacttaggtaagttatttaacctctctgaatttgtttccctgtatgtaaaatgggaactgtatttttagtaattcattgaattgtaatgactaaatgaactgatgtacataaaacctcaacacaatatctgtcatgtggtaaatgctcagatattgcaggtcattattattcatgttattgttattattattaacattagtattaatacaatttctcctcctggcctgtgagcccctaggggcatagtccattgaaaattcatttctgtctccccacagagtctagcacaaggccggtctcccagcagatattaataaatgattgctaaaacagtcttggaggttcacacaaatcaagtgcaaaataactcaaagggcatggtcaagggtaaagagccttgtcaggaccctgaaaaaccccaacagatgtcctgaagggagttttttgtcacccatggagccaggctgcaggactgctaggaccattcattcattcattcgtttattcatcacactgacacccaattttcactttggttgactaacaaacccttgcccggtgctttttcctattgtgaaatctcgtttccatctgctacctcatttagtctccacgaaaattttgagaagaagatagaataggtacattactgacaatccattctgtaaatagatgaaggcccagagaggtgacaaggcttgacaaaggacatacagctgtcaaggccacagtgggaaacggaccaaggctctgctcatgatcttgactccttcctgctggcactttccaaatccaggatcattcattcttgattctcattgtccagtttgcttctcagcaaataaaactgaattaaattatttttggtgttattttaacatgactgttggaaaagaaagactctaaattccataagggcagagactatgagagccctaacagtgtgggggcaggtaaatgtatgaactctgatcccagactgcatgcgtccgaatcctgattctgatacttaatagctgtgggaccttgggcaaattacttaacctctctgtgcttcaatttcttcctctataaaaaaaggataataatagctatctatagggttgttgtgaggattaagtgatccaatccgtgtacaatccctagaacagtacctggtgcatagtaagggttagttgtaattattatttgtattattatttgtgacgtatctcctgcacctagcataagacccaacacataaaaaatccctaataaatatttattggattgttgaatggataaaatactttctgtaaagaagtaagtatctatgctttaagtattattaaatatctatgcttaagtattattgagcaaggcaaaagaatagctgaagctctggccccaaagaagctggagtcccccagttccttgctcacagatctaggcgggaggagattcgtgattccaggattcaaaggcctgtccaccaactggcagtaaatgtgactcatggttaggaacacaggttttagagtcagacacttaaattcaagtcctcactcttgttctgtcactcactagttgtatacttacctcctgtacttgcctcagtaccctcatctgtaaaatgggaatactcacacctaccttgaagggatgttgggtggattaaatgtcatatgcaggaggtgaagcttcctgcacctgggcccagtccacagccacagtaacaatgagcttacaggatcaacagcagctcatcctatgggccaacttgttctgtgctaagcatcgcttccaccgctttctccctcacatgggatttgggggccttcaccagggatggactcatttgcatagcccaggctccaccttctaggccaaaaggctgctatgaaaaggcacattctctatttggcttcagcatgaactgggctctgtggaggcgagacagctgcttaggaaatgggctcctgggaaaggtggtctccagagaatcagcttagagaattccttgcaagcgccagtgccagcaactagcagcctgtatgcagctgcctctgagtcagtcccagtccctgtggtggctacagacccttcctttactctgtttctcccactaagaccccaaggctggcagcctgtcctgcttatgggaaggagctaacatccattgagccagaagctttaattctttgcctcgtttagacttcacaatgagtctgcagtgggcacttgaatcttgccacataccagccatgagaccctgggcaaaccattcagctgcccatgtctgtttccttaactatgagcacatgtcaatatccttgtacactagacccattttgcagaaaaggaagctgaaccatagagagggaaaggcattgtcaagatcatagaactaataaatgacaaagctggagctgtttgacttcaaagttccatgcattcattcatccatcaattattattttagagcctaccttatggtgggcactggctccatagactgtttttaaaaatatctgtattatcaatttcccactgctcctaagataccagtatgcaaggcaattcaatttaacaaagacatcaagtccttctatgtgcccaggcactgtgcgaggttctggtataaaggatcacattgaaccctcatgacaatcctgtgcagttgacctttttatgccctttacagaggacaaaatgggtaattcaaagaggcaagagaacgtgtccaggctcactcacggagcctggatggacgcctatgcccatgtgatgccaaaactcacttctttcccttcccaccatgtttctttctctacgctctcatctccccaccctggcctggcctgcaatgatgcagcctctggaagttccatcagtatccctggcagagggtgttctccatccagcagagaaggacagctgtcagccctaccagcctgtgccatccacactggatcttcaggactctgcttctccctggctccttccactccctgaacttgaccccaggatgacagacctataaaacccagaaacatgtttgcttgtatcttgcctacttccaaaaaggatgtgaggaaggttaaggaacaaaagtgcagaccgaggctcaaaacactggacaaaagcaaaatccagatgtaaaagagcagggggtgctggaagcaaatgttttgaaggacactgcccggcgctcacagggtgtgaggaaatgggtgctctcacatcgctgctggtagtgaaaatagacagaatgcttttgaaaggcaacttcagagcgtgcatcaagaactttgcctcacaaatatccacacttctgggtgtagtcatcccaattcccagaaagacagtctaagaaaaaaaattctaagcaagttccatgcagtcttacttctaatactgaggcattgaataccgacagcaaatctaagtgctaacacagggaaagggctaacacaccattgaaaactagggtacagctatatcaagggttgatagcctgcagtacaaatccaactggtagcctgtttttgtaaataaagttttattgggacacaaccatgcaaacacatggaaagggttaacctaccattgaaaactagggtacagctatatcagaggttgacagcctgcaggacaaatcagggtacatgtgcaagtttgttacatgggtatattttgtgatgctgaggtttgggcttcaaatgatctcattgcccaagtgtgaacatagtacactataggtagtttttcaacccttaccccctttcctccctgtccccttttaggattcccagtgtttattgttctcatcgttgtgtccgaatacatgtgttttatttttatttatttacttattttttttgagacggagtcttgctctgttgttcaagctgaagtgtgatctcagttcactgcaacctctgcctcccaggttcaagaaattttcctgcctcagcctccctaatagctgggattacatgtgtgcaccaccacacctcgctaatttttgtatttttagtagaagcggggtttcagcatgttggccaggctggccttgaactcctgacctcaggtgatccacccaccttggccttccaaagtgctgggattacaggcgtaagccaccgtgccaggctggaatacatgtattttaaaaagagagataactagctgaatatgctctgggcgtattagtggccacagtaaagagtgaagatgggttttaattgtctggcagtaggaggggaccaggaaaccaggaaagtcaaactctcctggcccagattttggagaggaattagtcaccagggtctttgtttcaaggagtttctgagcaacacaatggacaactttctctactgttccgccgatgttctgaggtgttgcccacatagacagcaagtcctggttattggtcctctaacaatgtcaaagaaagaatgttaagctatcgttctataaaggcaattcactcagtggtcagggtgatataggagttcagttcaaataaaatattgcagaatcttctagaaaaaagcatcatcatatctagctgaccagtgagttttagccagagaatattttctttgaaaataacccttaaattgcagatcagcatgtaagacagataaaggcagggtactctggtggaagctgtgctgggtatatttcatgctgctcccctcagctcccccggggctgccccttgaaggggttctgcaggacctctggggcttcttagagcccagctggtgaactgctacattagaccatccccagggcacctgctgcatccctggtcttttgccaagtcgagggcactggcaggagaagcagaggatactctgctacccacagaaggcagaaccatgtcctctagaaaccagaactaccacgagggcaatgacaagatttcgttgtgaaaattaaaaagtgcgacttatgattatgcttccatggagggccttgggtggggcaagaaaggacttaccctctctcggatggcagttctggagcagtttcaaagtctcttaaagggccaaggctgaggcccaagtccccgtactgggaagggtgaggagggtctctggcgggtggatatgcctagaggacaaatgtgtgaaccaaggtttttgatccattttcattccaagagggaagaacaagaagcctattgggagttgggtgtagatggtacagtgaagtcactaagagggggatcttgggtcagatttgaatcctgctctgctacttattagctgtgcccatgagaaagttactgactctttctaaacctcagtttcctcatctgtagaaaaggaaaatgaaagccatatatgatagagttgtgggaagaataaaatgatttactgcatgccaagtgcttagcaccttacctgccctaatgaatacatgctcaataacggtttgctatctgcagcaatagacctggccaagccgaaccctggcctgtcaggagtcagtaagcctggggtttgaccttcaattcatgtgggcttgaagaaagattcagggatgttccggggctgacaccagtttcctgtagctgatgagcagaagacttgttagaatttctagagtgactgggagatgccaggaggggccatcccccaggtgagtgcacagggagcctctagaaggattcgatagaatcctctgccctatcagggtgacattagggagggactacctttgtggggacctgagagagtgcttcatgtaccttctgctctgagtgaccagccccatgcagttgagattgtacatcgtttacctccacatgggaaggcatgccagtcaatctctgctctgtctctgggtcaagcatcatgtgctaccgtggtgggcatttgttgacttttgcccacttggcaccccttctccccactttggcaatagcattctgatttcatttggggaaatcagctctcctggtcttggtggacagtaaatcagggcttcctgctttctcacaaccaaggggagggcatgagcctaagccaggcatctcagatgctctttgccaggccctgactctgcgagctcattcttccatctctgtggccatgacaagaccacttctgattagttcctgttttctggtccctggaggggccctggatccttttctgagtctgcttcttcagccttcctgtcaattccgtaagattctcattatccttctgatatattccctctttgcttaagttatctcaagtcagcttctgttgcttacactgaagagccctaatggtttctgagaggaacaagtcaaatggcttcctttggcacaaaaagctatgaccaggagctctggcaccaaaactgcaaacaagaaaacttcaagtcaagtactagaagcaacctagtagccatgtcatcccccatgtcttctctgctgttggaggctgcttttattggggtgagctcagaactgaatgaaactccattccattttccagtgattggctcatatgactcagttctggtcagcggggtaaattactcccattttagagttaagggaagcctttctcaggggttctgggaaagagtttctttgctaataaaaagagaatctggggaagatgttcctcttctgcaccccctaccaccacatggcatatggccctggactgtgccagctacccatggccttgggtcatgacactgcagctatggaggtgaggctggccaacggggaagctggaacatgcctggattctggatttctgggctgtacgtttttcagcttttgaaccactcctacctccactctttggagtgaaacccctattgtgtaagtcccttgtagttagctttctgttacctgcagcccaaagcctcctaacagccaagcgagctttaaacctgggaatgggcaccccagcagcaggccaggacagctgcatccgggtcatgtcaggtggaagcccagagaaaggagcatccagtgagtggggcagacctgtggtggatccaagcagggccattcacgggtgggacagaggcagcctccaggcagtagcaatctctgaggtcagaagaaaggcagtgtcatttcctgacgatcttccttgtttagggcaggaaaccagcctatagcttgaggacatggagaacagaaccaagccccaagtggggtttgggtggaatggtgatcgccagtcaggggctcactgaggactggagttcatgtggggctctggctttgtagataattggagtcttaggcagggaaattgaggcagaaagaggcaaatccagttatgctgagtcactgacacggcaaagtttaggcgagggtgcagctcagtaacccccgccctccactgccatccataggaatgccagatgcagagttcagggcaatggggtcaattgcagcttctgctggcccactgggaactaagattctgctggctttagccaggttcagctcaggtgatgaataggcattttggagggacgtgtctggagtggggcagggggaggtagggactttcggttaagaacccacttccaccagcagctgagaaagccctagggaagtttctagctgtgccaatctgagtcaacatgcaagcaaccctaatgcccgaagagagctctactcaagttcaaggcagagtgttggtccagcactctgccctccatcccattcttcgtgcatcagccaggggatttgtcacttcctcctgccacatttctcatctgcacactctgcctcttcagagctcccacctcccctctcctagcatggagcaaaaccccaaaatagtccctgggggtcatctgcagggctagaaagattctaaaagtgtaccctcttcatgtgaccaaaaggaaaacagaagcacagagaagagcaagggtgttctgtcatcctgctgtgtgacccagggcagccaacaccatttctaaggtcgcgccagctctgacatcccatggctttgcttcaaaaggacaagcacatgtgaagtggtcaatgaattcttcagagccttatggaatggctctaactctaagccctcagtgagggtctgactatcctctcccccatctcttctcttccaatggctggtcccctgcgccaactggccagcacagtcctactccttgctctcagcccagtcctccctctcacaatgaggcgcatctaaagagcccccgcccaggcttccctgccctaatactgtgtcctgtgtctagaaactatgtgtctgtctcgttcccaaggccaagcacccaccttattcctgggcactggtgctgtgtcctgccgtggcctcacaccccaagcctgactccccaatccctgtggccgtgcagcagtggtcaccataggatggcggctgatcatagcttcttaaggacctgattcctgctaggttctcagctaagaatttgacatggattactccactgactccccaaagagggccttatcgtatagtcaccatcgctactctcactttacagataaggaagctgaagaccggagaaatcaaccagcttgctgaaggttgcttggctggtaagcggtagtgcctcgaagatgtccctgagtcagcccttttctctggactctccgctctgctgcgggcctagactgcagtccccactgccacccaccgggctggccttctagtgccctcccttccctttgcgcactattggtcacaagttcctggcttctctcaattagtagccccaggcctatgcctggccatgatatctccttcagagaggggtgagatttgacaggacccagaagaacaggcagagggtacggggaggccaggaagaggccagaaatcaaggctggtgatttgcaaatgcagagcccatggcagcatccatggcgtctactggttccctctccagctcgctcactggcagttgctgggctatagcttcatgggctgatggtggccgagcaccaccaccacccagcagacactaaggagcacggtgaaaaagcctgggctttggggccagacagtcctgtgttcagatcccagctctgtcccttagaagctctgcaagtttgaggaagttccatgggaaggtgatctctttgagccttagacttccaagcaataaaatggggttgataacaccgatcctgcatagcctttgtgaagacatatgaaaagcatttgtcaaatgcccggctttcggtaaaagctggttcccttttatgccttctcctcgtccttcctgctaccccttggagctggctgtctcccgatgccagagacaggctctctgtgttgagcggcccgagtggttccaacgatgcccaccacgtggctggcaggggcccgagcacactcggcacactggagataaatacagggtccaggcacctgactctaaacaatgggctattctggggttttaattgctcataaaagggaaggcaggctctgggcggtgaccaaccttggaggtcaggacatgcattggggtggcaaacagggcagcaaacacaccaaggtgcaggtgcagaaacgccagccagcaggtcgctaatcccagaatgtcactgagggagggtggctaacaagcctctaggatgattaccctctcagtgtacaaatggggaaactgaggtccggggaggagagcactttattctactgcttcaacaagtactcatcaagcacctgctccaggctgtgctccgtgctctgcctcagcatttcactgcgtgaagcagagacagattcgacacatgcagttacagtgccctgcgacaagtggcaggagaagcaggaacagggccatggtgatatgaaggaggcatgccgccctagtcgcatgcaccattcattccgtaaagatgcgcccactgcttgtgcgcaccaggcactgctcaggtgctggagacacagccctggacgaaggccaggccctgcctctgtggggtttccagtctcctggcagagaaaggcagtagtataaatgaagaggtagagaatgtaacatcagggtgtgtaagcaccgaaaaggaaaacaaagcagggtaaggggacactgggcacctgtggctggccgatggtttaggcagatggtcagggccgatgctaacagtgacaaattaactttagcacatgagatgcgcaggacaataaaggctctgcccttctgagtgaagagggaaaccagcgtcctgagctgacctgcctcaggggtctcagaaaaccagaaacagagccacaacctgtcccaggtctcttgtatcacaggccagagctggtcccctgcatggcccggcagcccctcccttcatagacaccgttcctccctccatcctccctggggagaagcaacaaactggtgccctcccaggctggaggccaaagccaccaggccttttcagccatcacctccttcctggccagttgcccatgctggcctcaggcagtggagcctgacaggagatccttggcctcctgacacagcggggcaggcttgtccttccctctgccacctcccaccgatgtggaagtcttggtgtcagacacacgtggtccttccacttctgagatgtgtgaccttgacaagttcagcagagcatttgtcaaaactggatgctgggccattctcacagagcccctgggaggattaaataaagtaagaaataaaaggcccccaggagcctatggcctgcagcaggcttggtaggcacggacaccttcccctcttgcagtgtcctcccacccccgatctgcgccccagcccagagcatcactccctcttctgagctcccactgccctgaaagcacttgttttctctttctgggtctgctctttgtccctgaataggactgccaactctcagagagcagtctctggcttctgcaagtccctgagcctcctgcctggggctcagctcagagagtcacatgcagtcgctgctcaataaatgttcttccaagtagctttcagccacgaaagtttaacttggagaataatggggcatgtagagctctggattcacagtcagcctctttatcagctaaatgaccctgggcaagttaactttttatgtaaatgaggataatcaccaaataccccaaggttctgcaaaattatatggtgattttaacattattgtttccattatggaatcataggtggagacaagagtctattaaatttgtaacctggtactacagttcttcccacaacatccagccccctggatgttcggcctctacttgaactctccagtgacagggaactcactacctgctgggcagcccatgccatgttttgactgcttctgagcattagaaacttggctttctattgttttaagacctgccatgctgagctctggaatgcagggaaatgagtgggtgatgagcaagcctgggggaggggctggagagagctgcaggatgatggtgggagggtggcagggagctgagagccccccgaaacaatgctgctggtcagtgggccacaggctgtcagctccccttccaagagaagctcctgataatggtgcctcatctgctcatggcttcagaacctgccagcccttccagaagactgcctcctgcccagggctgctcagcagctggactacaggggcccgggttctcaagccctgatgtatgatttatgactccgatgagctcaccagctcagggagggagggtgatccgaggggaggctggaagaaggctggttatggattttaaccctctgatgttactggctgggaatttaacatcaataattcaaggcagtggggagcaagggatgggaaaaaggcaaaagagagagggaggtggggatggaaagggagaaaagaggagaagaagtggaggacgggaagaagacaggaaaagaggcaaagatgcatttattgagtgtttcccatgggtaccatgccaccttcgcctcctttagctcatttaagactcactgaaatctatgaggcagatactgtcacctctaatgactggataaagaaattaatgctccaagaggaaaagcaaagatttcaaggacagcaggggggatgaggggatgggatttggatccatgtttgctgattccagaacacgggttctttctactacaccttgactttagagggtagccaggtcaggggacacagagggtccctgctggcctcaggacacctggccccagctcacactctggggctgacatggggagagatgagtctgaagggcttggcccctgggagagaaaccagccactggccttctggacagcaccaaaactttgttgctgaagctgaaaaaattaactgctatatttaaaagcattgttcagttgctatggtaacagaggggctaagaataatataaaaagaagatgatatgccaggttgtcactggcaacccaattttaagggtgtgtgtgtgtatgtgttttaaaaggagttttctggggggaggtgttgaggttcagactgtcttccccactccctccggcaccatctgccccagcgacatgtccaaggtgcagccaggcctggcatctcactggtctgctggcatcgggggagctggcacaccctggccctgagcctaaagataacgaaggctctcagctccctaactgctgtcccctcctggcagccccccactgcctgggctgcttccttcagctgcggaaccccagccggaggcacctctcaaacagatggcccccaaatagcttcttctctccgacctgggagctttcagccagcctggcagactccctggggaccaccagggaaaacagatggtcaggagagaagagcaggagacagatttattgatctgcagcatggatgtcagagataggaggcggcttggcagatctgggcatggggctgccctactccctgacgtgtcctggtgagacatgccaggtccagcctgagtcttcagcctgggcccaggcgacctgaaggggacccacggcaagcctggggagggtgggaagatggatggggactgggggtcctcacgcaccagccaactgtttgtcagggctgtgatggcagcacccatgggaaccatgggaagaactgggtggcaaaaagacaaaatccccaaggcagtttattgacagccaaggattagaaagaggcctggtatttttactgtgtcatggtcatgcaatatgaaggagagttttgaaatcagactggggtccccaggccggctttgctgcatgctaccatgtgacctcaagccaggccctcagcatcttggtgctaccatagggaaaatgagagtgacccttaggactatggttgggcctcaataaactgaagtttatcaaacaccaggcttcatgcctataatatcctcagcaggcagccctgtctgccaggagaaaccttcaccttagcatttctctatgtcaggcccaaaccgaaagccacagaggaacttgcacatatacacagggaatgagacacagtgagaggtgccttcacatggaagtggacggtggggccccgagcaaccgatcatgcctggagtgggcagggaaatctgaaggaagagtttgaggtagtccttgaagcaggagaacggcagggtgacagaagcacactccatgtggaggaaagcagcaaaggccgggcagggtgcagggagcacagggagggcttgctgagggcaagtcttagcctctgaggccagaacctaccagcaaggtgggcaggaagaagggaaatgatcagagctgggtgaggctcgatagggaggctggctgggctgggtgaacccagaggcagggaggcccatggggatgctgggcaaaagtcccagccagagataagggggctgggccaaggtaggacagtgctttacagtttacaaggcgtggccatgtccattacctcatttatcatcacaggatggagagagtttgctgccccacccaagctctccccccatcaccacctatcagcacttcccacaggctgggggcacccaccatgtacagaaggagctacatctagattcctgagcatcccctagaagtggaagagtccagaagagctggggggccccgatgagggtgagatctcatgagtgggtgtggccacaaagggcttcttgtaggaggagcagtgggagggccctctggacagacagcatgcttcaaacaaagctgggggatgggacaggtcatggtgcattgggaaatagtccctggaccctgctgggagaaagcaggttggggatccaggcaggtctgggtcacggagggccctgaattccagctgagaggctgcatcctcctgcaggcagtaacaagccgtggggagctcagaggggctggggcaggagagggagatgtgaacgaagccggttagaagccaggctgcatcagacaccactgccttcctcctctctgtcactctcaggcatgactctccttctcccctggctgtctgagtgccagcaacagaaagcaggcctcaagctgcacgcacgttgtggaagacgagtatgtttactcagcagcacacagccagctctgcccaggcctcggcctggcagtcttctcttttggggagagctggttgccctgtgtcctgctctgagggcacgcagttgtgaccttggtttcccatggtgaaggcacccagagtggtacctgggggaaggttctgggtctcgtgggagttcaggctgagccaggagagagctgcccaagtggctcagcatctggggaccagaacttgggcaggggaggatcccatggagcttgcattttccgacgctctttcccttattccctccaaccaatatttgttgaatacctactttgtgtcaggcgctattctaggcggtgaatcagacaagaaaaactcctgtcctcttggaacttaaattctaataggggaaacagacaacattcaaacaaagaaatgttgtcaggtggtaatgagccctatgaaagaaaatacagacaacttgagaaaggaaagagaaagtgactagagaaggtgcttgagttgatgtgatcagggaaggcttctctaaggagatgaggttctaggggtgacatctgagcaaaggcctgggtgaagtgagggagcaggggcacaaggatttcaggcacggggttggtacatgcaaaggccctgaggcaggaataagcctggtgtgtttctctgactccttgtctagtgctcttgggaaaagagaggctcaggcaggttaggtgacttgcctggaaccatgctgcagatcagtggctgagcaggaccagaggcaagttttctgcctgtttatccaggggtcgcccaccatatgtggactgggcacatttcaggcatggaccctggccagaggatggacattgactgtaggggagggtgagtcagtcattcagtcaacaaacgctgactgagcgcctagctcacggcaggctctggctgtgctgggccctagcacacagcagggcacccatggatggaagcgcatgtccccctggagcctgcattctagtggagatcagagattatggggatcatgggattccaggaccctagaatctgtggccagaatctggaaatcccagaatcagaatgaccggtatcttagcatccaaggattcggaatcccccaagcacggcttctccatatgggaaattggcagggcccttcagcggcatccagcccattttaaagaggggtggaaccaaggtctggtgcactgaatgtcccacatagggtggccagtggtggaaccagggcctttgccaaggagtctgggcttctggggcagtgaggcgactgtgggcaatggggatgaatacaggcttaggccagacagactggccgtgggtctgtaccctacgcttgctatgtcgtggaatctttctaaatctcagcttcctcatctgtaaaatggcactaagatggcatctacctcaaatggttgtcgtgagaattaagataatctacgtaaagtgcttagcatggcaaatgcttctaacacttgctgttgtgctggtaattattagtgagacttcaataacactggtatgaagtgttagatgacagagattgaaccctgctggaatgggaacagcggacctgccccagccacccggcttagcatcccacagaggatctgcccaggcgtgtcagctgatgggaataagggttgtttcactctcacctccagagacaaacatggtgtgtgtggcctggcacgagtccattgccctcctctctccatctctcctgtcttcccattccctcctctgtctctgtctctctctttctttctctctttcacacccacacacacacacacacacacacgtgcacacacacacacacgtatgtgctgtaattatagccataagaccttgacccagcccagagcagtgaaagctgagaccaaaggcattagaacgaaggcgctagtggattttagctgggggtcaaggtacatgttttaacccttcctctttgctggactgaaactaggcttgatggactaggacccaccaggaggttagaagggcaacagcccatggccaagtgggagtaacaagaagcacattcttaatactgtgagagataaaggccagatagctaaaattgagggctcagagtgtgctgctgcagctaaagacaagagctgcacaaaggacaaccaggtaccctggaagacttcctggaggaggagagagaggagctttgaaggatggggaggatttgaccatataatttattgctctatatgaaaacagcattcaaggacaaagtcaaacaaaatcaagtacaaaggcacagaggctcaaactgttagggtgcaggagacagtgaagctcctcttacaggttagatggaagtgaaacagactgggaggtggagcaagaacttgttttgcctttagttctcgcctttaccttgaaacaatggtcattccttcattcatatgaataactcatctatctaaaacaattttaggcagccctagtgagccctagtgagttttccttcccttggctcaatttctccatctcctaaatggatttgtcactgacatggagagggagactgcccaagagcagatgttcctgaactagtagtcagctgttggctgctccacatcactcagggacgtccctgtccccaccatgaagtcttaggctcattggaaagccttggggttcttgagatgtccgtctttctggggcaagttcacaataacagagaaagatgacacggtgaccaggctccagaaggagacacacagagcccttcctcagggtcacttcaacctcacagcagccccagtgggactcctgactcatgttagcaccaacacagggaaccactaagccttggagaagttcagtgtcttgcctgagtcctatatctggtaaactggcagagccaggctaggaagcccagacgcttcctggctcctatgtcctttccatcaggccaggctgtctcttgccctaagttgcacaggccaagaacagaagctaagacggaagtgatttattcccaggtacacaaggactcaaactgtggagcggggctggggtccagccacacactgagctccagaggcccagttctggtttcagctgagtggccctaccaagctacttgctttcctacgtctcccctcaaacatcctccccaccctccatctacatcgcagatgccaaaaagtcatcagagcaggcaggaaattccataattggcatgctaaacctgatgagctcaggacaccacctctgagtgggcctccagggctgctcccaggccccagactgcaactcttgaagggcctaaagaagggagatcctataattttccccatttgggacattcaacaaatagaatggttcattcacagatttactccatttggacacatcgggaatagccttgggtctgtctagaaagagacatgttcatccagctctgactcacccagttccagcactgaatatactacattattattctaccttttcaaagcctattatgtgtgattcctatgtgaggagttgagggagctacaggtgagaccagagtcaggctctaatgtcaagaggctcctaagacaagaaattagaacacttgtgcactgctggtaggaatgtaaaatggtgcagccactatggggaacagtatggaagttcctcaacaaattaaaaatagaactaccatatgatctagcaatcccactgctgggtatttatccaaaaggattgaaaacaagatctcaaagagatatttgcactcttatgttcattacagcattacccacaatagtcaagatgtggaaaaaacccaaatgtccatccagatgaatggataaagaaaatgtggtacacacatacagttgaatattattcagccttaaaaaagaaggaaatcctgcaatatgtgacagcatggatgaacctggaggacattatgctaagtgaaataggcacagaaggacagatactgcataattccacttagacgtagtgtctaaaatagtcaaactcacagaagcagacagtagaatagtgggtgccaggagctgggggaacgggaaatgggaagttgctgctcaaggagtataaatgttcagttaagcaagttgactaagttctagagacctgctgtgcaacatttgcctatgatgaatgatactttatctacttaaacattggttgaaaggtagatctcatgtgaaacattcttactgcaattttttttttttttgagacagagtttcagtttcactattgtcgcccaggctggagtgcaatggagcgatctcggctcactgcaacctccacatcccaggttcaagcgattctcctgtctcagccccgagtaggtgggattacaggcgcatgccaccgcgctcgactaatttttgtatttttagtggagacgggatttcatcatattggtcaggctggtctcgaactcctgacctcaggtgatccgcccacctcggcctcccaaagtgctgggattacagatgtgagccaccatgcctgacccttactgcaatttttttaaaagctcataagctagaacaagagacgtaggtaggtgcataggttaatcaatagtgctaatagcaaatatttatataatctggatcctgcatcaggcacagttctgagtttttacctgtattaactcacttgacacttgcaatgctattaatactatgaaggaagtatcattatcatctctgctgtacagaggaggaaactgaggcatagaggggttgagtcatggactcacaattgctctgctgctcacaggaacagagctgggatgggagcccaggcaggcagctccagaatctgtgctcctaaccccacacggtgctgtccatcggtgcacagaactgccttccctaacagaggtgtgccctgggtagcacagaggctagtgagcgtgatccactccatcagagggaggggcatggacattttcctagaggagtgatgcctgcacagactctcaatgatgaagctctccatcatctctgaagactaatgaagccagccataaacatgccatgggaggaactgagagggcctctggccaagcaggctgcccctacccctgcccctgggatctctacctccccacctgaccctagtagggtcttcttcctccctcatgcaagctcctggaactcttggtgtgtatctccttcgcagtgtggaccacaatcagctttgtctctgctgcagacttgtcttacctccctccagtggagtccttgttccacctcccttcacctctctgacatctctagctcccagcacaggcctgggatgtagctcgtgcttgtgaaatacttgttgcactgatactagttttccacatatatcagggctggccctggctggacctggagatcagcaaaataaatttggctggccttccttccttccttccttccttccttccttccttccttccttctttccttccttccttcctccccttccctctcccctccctctcccctccccttcccttcccttccctcctttcctcccttctctccctccctccctccctccttccctccttcccttccttctgcctgcctttcttccctccacttttagcaggtatttattgagtatccattgtatgtggcaggtgcaatgcagcaggacagtctctattctgtgggcactcacagtctagtcaaggagacagactagcaaaaagacaattgttggtgaaatgcattctgacatgagtccagggagcataggagcacatgaaatccacaggcttccacaggtgtggaggaagtaatcaaggaagacttctgggaaatggcatctaaactgagacttgaatattgagtgtgcatgcatgtgcatatgtgtatgtgtgagagaaacaggaagaaagagaaagacagagagagagatgcatgtgtgtgtgtgagctaggaagcaagaggttaaggccagagctttgagggaaagaggtaagaccaggtaggagatcctgagggtccttgcaagttgctctaaaggaatttagcatttaaccccagaggccatggggagctattaaaggattttatttggggaatgacgtgaccaggtttgtgttctagaaagatccccctggtgcactatggggaacaaattagagggggcatggtggtggcagataaaagcagctacagaaatccaggtaagacaaggctgttagcagtaggagtgacaggaagggacacatctgccagatcttgagtcacttgattttccttgggggttgggggatcaggaatgagccctgagtttgggtcatctcatcccttccatggggcccctctctttcctgccaccatccccatccttatcccattgttgtaacggaaagtcatggaattcttgggggaactccatgaaatactaaagttctggttccatcacaagaactgggaacaattttcactagcagaaaatgcacccataccataaaatcatacacacacacacacacagccaccacacacacacacacacacacacacacacagccaccataaaaaaatatgctgcaaaactccgcagaattggctggttttgatattcctcattaatatttgtttgctacttgtacatttcattttattgcctatgagcactcattagcagtcaagcagtagcaagtgcccagagcttatgaaaagccaatgggagaaaactagaagaatgagataatgataagtaataactttgtcctttactgcaaattgggaagagctaggtattggtttagtgtaggagtgaaacatctcagcacagccctcagagcccagggtcagggttaggattagggttagcactttcataggtttcttctggtcaaggctggaaagcaatctgattaactagatcatggtaaggaatgaatgaccaccagagtagcttaatcctgcctggaggtactagcagctcggctttagagatggagaggaagtaagctttcccaacttccttcaaatgctataatctgcctgtaaactcagaggataatacagatgttagtttctcttgcgataataatatcatgaggggggaggggcagctcgaggatgaatctttttctccaggtttgcagcggtagcttgaagtagtgtcttggggtggactctgacatccccttccaccactatccactgtcaccttccgaagccactccaaatgagcaaacataaactctaggttaaaagtgtgcttattctacaaatgcagcttcaagataagtcttctgtatgttcccacccctcaccagaatactgtccctgggatcctcctctgagaacagttggcaaagctggttggtccccttagggagaaaagggctggccttcatatggaatgcctagggctgaataaacaatcagatggggtttccttcctgacctactactgctgccaagtaaagtgaacagaaacgtccaccacagaaggccattctccagatgagaaaaccaaggatcagagaacaaagacttggcttggattacatatgcaggaggttcctgcacatctggccacacctaccctttctggctctttgggacatatgatggagactggaggcttccaactctgagctgatgcacgggtaatggacaggggcagctccacgtcagtgagacgtgatgcattaagatgctgataccatggaaaaaactgggaggtgtgagcccctccccagccatcacacacaggccaaacatctggtctgcactaagggcacctgccaaatctcgcctgaggccatgaactccagcccaggtgagacggttctgttcctttgcaagggtggcccctaggcctggacaaggctgaggtgagagtccggctggggctcagcagaagcctgtgaatgactccggttgtgctctcacaccaagacaaagaatagcactggcatctcccacctgaagtttcacaatggtctacttagcctttctcacccacaatcccacaccaactcagggaagaaagaccagctgtttgttttcctacttggcagaggaggaaactgaggttcagagtggtcaagtgacctgcccagagtcatacagcaagtgaatgagaaaggcagaattgaaacccaagactcaacactttttaccatctttgaatgaaacagctgaccctaagcaggatgggcacataagaggcacctctcatgctgtgaatggcatccctgaatcaagaacgcttcgggacatgcagacatgcagctgggcccctaactggttgccacttatcagccgatgtctcctcactcctgccacaagcctctcccagtcacagggacaagggaatgatggttccttacaaggaatagctgtcaagaggcaagagaacagacatctctttttcctgaattatgttagagcccaggagggatgttcaatcttcaagggcatgtgcggacctacctaatgcaacagcaatggaataactaagaattcccaggacttcccacctcccaaagcccaaactattgtctgtgctgatggtaactgctcgctccaagatgaatgggcagaagctgggatgaaaggcccagacacataggactgataaagcaaacaggttcagtgtccagcatccgtatggaaactccataagaggcaagggccaacagtcctctgtcccttcctccagtgacccccaaaagacaggcaggcactatcagatctccaggataggctcaacaatactggaaaacaggtgtattgtccccattttgcagatgaggacatagtggctcagagagatgagttgaccagtcccagggtcattttaagacccaagctgcattacttttggaagcctccccgacattctataaaatttatcccttgctgaatgtaatattttgctggaaaacaactatacatttaaaagataattttgtttttgaagtgattttcagtgagtaacctgtagtatgaatgatatgctctgatttctcagcagtcattgtctgcaatcaggaaccttggcaaggtgaggcatgctaacccccaaaaggagggctgtttctataaaaactaaatcatacaattcattatgcttgagtatattaactaaatattaattttgatgagcagttttcatattttgaaaccaaacctttttcttttcatgtctcaagcattttcatgagccctcgagaagccacatgggcccatggtgtctcccgggtaaatcaaacccgggatggacctgagatttgaacacaggtctacttccaaaaccagggctccttcctcaatgtctggctgcctccaagagtcaaggcaccatctctaagttgtaacagggaaactaccaaatagaaccagcaggcaagcaggcatgaagggggctggaagtgaggccctttgagaagctgttacagattttgtagatgtttgatcataaacagccatggcagtgggtgacgtttacacacccgctcatgttaagtcccacagttacctccttttgagcgtggaggggttaggaaactcccagtgtcacatagatagcaagtggcctcaccacgatttgaactgggggagttgtgctctggagtccaaaatcttaactgctctgggatactgggacactggagcagaaggatttggggcaagtctggagaggcccaagtgcaatactgagacatctagaacaataggagagaggagatcagttcttttggggaaggtcaaagatagaggacaggtgtggaggctggcaggtctcagctgactagagagaagaactttcttaaaaaaggcagagctgtcgaacaatggagggctgccctaccctgagtgttgagtgcctggtggctggcagtctgcagggaaaatgatgcctctgtgctgggcatgggggcaggggctcttgctgtggtagagggctgtacatatggactccagagggcgtaagtgataatcctctcttcctttctcagaaccacctttctacaggctttggtgtctcagcgcgggaggcacagatggcgaggtctgcctttggccaggtgtgggcgcccagtgttgggggagaagactgcaggcacagaagactgaactcacaggcaggtccggagatgcagagctggtgttcactgggtttttctatgtgctagttactggagcttcacgtgtgtcatctccttctctcctcacactctctgagggtggacttcctcccatctcatagatgagaaagagcctggggcccagagaggctaagcagggaacctggggctgcttgggatcctagggcgatctgacagccacctcagcttccccaccacgagggatgaagccgggaggcagccccttcctgtgcctgacccctaccagctgggaaatgtggcccaggcaggcaaggcctctggggatcccaaagtggcagcaggcagtgggagctgagcagagaggagtaggggtgggctggggggacactgccagacggaaatgaaagtggccttgagaaaaaggaacgagggaagaaaagcagaaactaaaacaagtgacaaagaaaacgagagtgtccagaggaagtggctgaggggcgcggcgccgccggaggaatcccccgcagaccggtgtttcctctcttctcagaggcctcggggtggaggactagctgaccaactgctccgtcactttgggccagaggcagcccgggtgactttggcaagcatggcctcatcccgccagcctaggaaggagcaccagacacagagccccaagccctgggctggagtcgtagtcagctacttcctgctgggtcattctgggacatttattagacctctctagtacccagtttcctatctataaaatgggtataaccatcctgagcccaccacactgctggaaggatctcctgagcaaatgccctcatccagggcctgacgggtgcatgttggggtaggtgggctgtgcacacagcggcagggtgcaccttcaggatacctggggaacagacagggagagtatccaccatcttattgttgaacaagaatgcatcaacgcttgctggtccttaatcaccctaggctttgtcaggcctgggaacaaagggctgaataagggccagtctattcccaattacagactctgcatgcaactccagttccttatcccagctctcctacttggtagctgtgcaaccttgagcaagtgacttgacctctctgagtatctttcttcacccataaagctagaacaataagcatatctgtcttctaggttgcaaggaataaatgagaccacactcaatccaaagccaggcacaaattcctcagccccagcccagggagtgcccagcctagaggggagctggagtccaaggacatgagcaggctgtaatgatagacggcacccaggcctggggcactcagtgctgggcaggggatgcggggctggttctgccaaggcgacagagcagggggagtaagggggggtgaaatgtaatcccaaggggacagcatgagcaaatgtgcaggggaggggccaaaggcgatatgcttgggatctgcagagggtggatgaggccagacttgttctcaatctacagccccactgacagttctcagactggccctggaagtgatacgggcatgccactggggatgctacagtcagctcttaatgcagggctggcttctagggtcagcttctacagccagacttgcctaggctgcagtttgtctccagacagacacgggaattcccccaaggggtgggcatggttcttgtgaactgctgtggcctgggactgggcttagagtacaggcagctgctgcggtgaaggtgtcagaaggcacaggctagggtcccagagaggtttaggagggggtttctctgctgggtgtttgctcagtgctggatggtgggtgctgagggcctcatttgcatagggagagcagctgctgtcccagccacactgctgcccacaatctccacgtggctgcaatctcgctctcagtcaccatctcccacatggactaggggttacccaggctgccttggccacgtgcttcccccaacacacagccatccaggaacaaccagaaatcagactactgtctccgccaccctcaggggttccattcagggagtccacctcccaaggtggctgtgggaataaaacgagatcctgggggaagcagagagcccagtgcacaggggtgatcagtaaccggcagcccctttccctgcctttccctctacttccaacattatgttgtgaagaacagggcagacctgggcccatgctatctctcaccctggctctgtgacttgaggcaactcactccaactctgtaaatcaactgctcatctgcaaaactggcaagaaactgagaaggcactggttctcagattggcaaagctcatcgtcactgcctcactccctcaactctatgtccagggaccacgggtttcccagggttcccaaacttgctgttggcaaagggcctgatatccgtcactgacctttttattctgaatgggtccccgttgactttaaagctggaatattcttagaggaattctaaactcctcctttccaactccctactcattttacagaaggagaaagtgaagagaagagagggagaagggccctgaccgaggccaccagcttgtaagtagcagccctaggcttgggaccagggcctcctgaaggtgacagtcctttcagccatgtgtccttgttcctctagttacctccaattaactctaggtaacccagcccagtctttgattctgtgttgaaaggtgcgaggtgctggagccgggaagaggtgcgttcttgctctcgacaggaagtgtcatgtgagtttccggttccctctcctccactaccactctggatcctcacaccagcccacagagggagacaggaagggaggcacaaaggcagggcagggaatactgtgcctgttttccagatgaagacacgaaggccaagagagggaaagtgagtcggccaaggtcctccagctagtcggggttgagcgtgtttaaccttaggaaacgtgactgcagagcaaggggctttcatcttcctgtgggaattcgccccctttctcacaggggccctcaagagactaggcaggctcctcctgcaaaggattcctctttgtccatttgagaggcctcaccccaggctctaggagctgacatgattcagctcaaggaagactcagtatgaagggagaaccaggaacctgggcctctgcccctcacctgtggccttgaacaggtcacttctcccctcaagccttggtgtcctcccctgtagagctgagggggtgaggagtagatgagctgatccttcagtttgctgccctctttgacccggaagtgctgggcctgcacaaccctgcatccctggcaccagtgctcctagccccaccctgctccagatgcccagtgcctgaagagccagctccccatcagcactcagtcctggggcagagccaggcctggcaatgctgggggagaccctggaggggaacatcatgggccaccaggggcacgctgcaaatgcagcaactaatgcaccaggggcgccagggtgcaatctatctaagcagttctctcacgctctttgcacgttaataatgcatgggcagccggtgtgggggccatcacaggcccaacgtcaggtggcattaggaggcctctaatggtcctgattatccggtgaaggctcccagtgggatgtgggcagcatgggcaggaagccaggattccgggcacttagaccccacaggtgggaggctggggggtggggcaagaggacagcttccataggccagggtcctattcaggggatctaatgggactagctgaggcttcctgtggggggtgaatttgtttgtgaagaggagcaaggacgcaactcccacagccagatcacaaagaaagtgggaagtcagaaacccagggctgagtgaaacctcttaaaatctctcctctgtggcgtctctgaccagtggctctgcagcaagtgcctctagggacaaggaactcactacctcctagagtgacacatgcccattctttgaacaagtgtgactgccgggaaaaaggtgtactgcgtacagctgtcaagaatgcaaatgccactgagtgttgggggcatgggtaagttggataaaggggctgatttgagagacagaggtgctgggttctaatactgaggattctccttgtcctcaggcagctccggagccatcaacctggccagtcttcacagcctaccccagtggcagaccccctgaatccaccccagggccccagtaagcccccgtgaacctgtgaactttgcatttctatgctcaacactcagggtgagcagtccagaaaaaacaacccatgcacagcaggtgctgggggtagtcaggcttcaagatgcctccaaatggttctcatctctgagtattcacactgaatggaactgacctatgtaactaacaggatgtcgtgggaatgacaggcatgacttccatggctaggtcataaagagattgtggcttctaccttgctctctcttggaccccagttgctggaggaagccatctgccatgtcaaacagcctatggagatgcccatgtggggaagaatggaggtcccctgccaacaatcagctttgacatgccaagcctgtgagggagccatctggaaagggagtcttccagccccaatcaggccttcagatgactgcagccctggccagctccttgactgcaacctcatgacagaccttgagcaagaactgctcagctaagctgcttctgaattcttaacctacagaaatgtctaatgctttaagaagcaaagtatggggtaatttaccacatgcaatagataacaaaaccatgtgcaataaatactggttaaacaagtgaatgattcccctgaccgagtgtttctctatggaagggtctggcatggaaccaggccctctggggcctatgggggatggagaggaaacaaaagatgaggacatggtcctctaggaaggctgtggcatgtggtggggaatgacaggtgcagaccagagggagcagtgtgagagctttggatgggctagactatgtggggaagatgaggaaggagttctgagagaggggaccacatgagccatggtgcagcttgggccggacggggagcatcagcagaggcgggttctccagtggctctcatcttgactgctgtatccctagcctccctgagacagctactattatcatctcaattttgtggatatggaaacggagattaagcaactcgcccagggtcaaaacgctgggaaatgatggagccaggatttgaactgaggagaccatggaacagaaaactagcagagggcggtcttaacaaggcccaaggagatgaggctccccagcagggtgactgaggggagggcacacaggtgctagggaaggtggccaaggaaaggccactggggctggtactataggagcatagaaaggcaggggaaagtagccttggggtggggggtgacaaaggccctgcctgagttgaggactacatggctttgtacccaagccactcttaccccagctggagcctcatgtctctcccaggatgctcttgctgggctctgtgcctgggctgaccaactcccttacacagctctgcctactccccatcatacagcacctggaccgcgacgctctatccccgaggacaaggcctgccttcccccaacagaaccccaaacacttcaagctacagtctccagagactctcttctccagagggccctgcagggatcagatgggactgggggtcggtaggagggcagaggacaccaggtttcagtccccatgggaggcaggagcatccccagcctgcctagtccccaggatctggttcacccatgtccctaggacccagccctgggcctggtacacagcaggtactcaatacatgtgcatggaataaataaaccagcagatgcagaactccatcctgcaaacacaaagcagttcagagcacactgggaaatcacatggaggaaatgttctggccatgaattttcatgctggtccctgataatccaggtcttttctgtcattgcccccagggactgctggcatcttcccggctgcactgggcaacactccatatggggctgtgctgagacatagtgacagagtggagggggtggggaagatgagaacacaagcaggggcagagccaagggatgggatgtccttggattctgaaacccgagtgctgacagccaatgtccaactcccaggtaccaagtggtaattactgtgaaaagcagacagcttgacaatggaggatgtagatttcacccaaggccttaccttgaaccctcccccagtcacatcacaggccatagggcttgtgggaagggtccttagtggccatccagcctctccctatatccaagaggaaactgaggcccggccaggagccgagaccctcaaagctcacctgagagttggtggtggagttagaactggaagccagagctcccatctcctattctgtcgctcaccaaacatggcctggctcttggggcgttgccctgggagacaagcctgtgctctgagggtccactgtggctgagtgacttaggggaattggttctgcaaaagaaagtgccaggcagggaagcagcaaccaagggactggaaagaggaaagggatgtggggaaggctctgggacaggcctccctggctcctcactctctttgtccccctgccaccttctcagaagcactctcagcatcccaggccagcctccagcccagtccttctcccaggctgttcctcggctctcaaggcctcagctcctccaggtgtcccactcctctcaacctccagcccctgcacagaactcacactccccgccctctcccccagcacaagctcacagtccccactccctggtccattccccttcctgcctggctgctgtgcaaggtgcaactcagccctcaccccctccttgctctattctccatgcccccaaatctgctgctgttcccacctcacccctcctggcctctccagtcagtgagcagaggctgcacccaccaggcctggggtgggctctctgaggctcatgtgcattgcagctgtctctgctgcactgagtggatggtgcctttggcttcagagccccctgcatctgaattgagttgctgccacctattctagctgtgtggccttggccagccagtaaacctctcttttcatctgaaaaacggagcagacaccttctgcacaggttaactaaagaaccagctggcacgcacatggcccagcgtttggcccagggaaggcgagagatagacatacattcagtgactggactaactcggcaaatgtttccagccaccccctcccatgcccagggtccaggctggtgttgaacatagtcaatggccactaagcatttcactgactgattcattcttgctgctgaaaggtgttcagccaaggagcgatgggccactgggtgatttagaaaggccctttgggctgccatggcggagggcagtctgggaaggaggggacagaagccaagagaccagagaggaggtgactgcagctctgtaaaggagtggagggctgggcaggtgggttgggcagtaggaagtccagccagagactcaggagcaggacccacagcagccagccccggggcaggacggcagttgaggactggggcagaatagaggaaaatatccaccaacgtgggtggctgcttgatgccattgggtgagacatgatctaaagaggaaaggcaggtttagggctgttgtctgcagcagtgaaaatgatgaaatgaggaattgggttttgcagtgttaagagagtgcttacagggtattcagggtgttgtctgtggggtacaatgtttgcgacaccaaacacatcccttcttcagtgccaagatagtgccccaccaacatgctctgcaacagcaaatcatttgccagtaccatgacttttttcaagtaatttatgtgcttcaacacatttgtcttcaacaaccctttgcagaaggcactataattatcatctccatttcacagataagaaacctgaggctcagagaggtggaatcatcttgcccaacaaattatcaacaaagcagaaattggagtcagttgcaaataatttctattgagtgcctgctgtttgggagatctcttcctacgtaagggcacgtagaaccatgtctagcacacagcatgcatattaacacttgctctgatggtgacgatggtgaagaagatgatgacgatgaaggtgacagggatgaggatgcacttctcacatctgattgaatccatttgacaattctaggaggagggcatgagtcccccttgtctgtggggaaaatgagccacaacagtgtgggagtttgtggcagtatgagggctgagctcaggtcacagaggtcagtgtcacccagagctcattcactgctctaaaatagaaccatccaggctctgctcactcccttcccccaaattagcaactttctaccactctgcctttctcccctatggctggcaggctggagatatgtctccagcctggagatttgggactcaggcattgctggggaattaaaccctgctctcctcctccgtcagcacaggcaaactccatgacaggcggatggaggatgtctgcctgctccctggccacccacgtgctatctaaattcactgccagacaaagccgcctctcgatcttggcgcctccctccctccctgccattcatgcactgagagattgcatttccagtaagtggaggctggagagagaaggaagcaagcaggagggtgggggctctgggggaagaaggaagaggagagaaaaaggcaagaacactgaatcaggcccaagagttagccccaccatcaaagtgacaacccattaaaaaaatgatttgtgggtgtgcaggggagacaccacctctgaagagccaccttttccatgctcaatgaggcagcatctgcagccagtgcccgcccagggtgtctgggagccgatggttatcacaacagcccttcacgctcccacttaggaaggaatctcgagagttccaatgttctgatccctccccacttttagaagcaaggagtgcccgggcttcatgcctccatggcattcgttctgggggaaacctgaacgaatttccaattgcatcccccgtggtgttcagatctctccctcctgcagagccttggcaggtgcattctctgtccataagaaaacagaccaagctcctttgacaagctacagatgctcagctccccgtggaaggggttgaggggccaagaagggtgggtcctggggccctgacaaggcttcctggctttgggagaaggaaggtagggccactgctcccccagctccttctgccacagaaaacagcctccccaggtaacctaagcaggggtcttgagaaaagtagccatcctgggtcctggctgtcttgtctgttaactgagagggctgcaccacatgccacccttccatgccccagatgcaggatgagcattcactgtgggcagatgcaggccaaggaaccagggcgtgcatttctggcttccctccgcaaactttcactgccttccagactctgtactggatgcctggggattaaggcacaaggatgatcacatgtgtgtccttgggtggctcagagtcccaaggaagaaacagatggagagcagaggccccatcatgaccggggcaggatggtggcctgtcagagggatgtggcctgaaggaagtgttgaaggaccaggaggagttctggctctttttctacccagagaagctgacacggttggccagggcactatagtcactccagggctgactcttcaggctccagccaccacctaccccttcttagaccctggtgcctactactcctgccccacctccaggcaccagccacaaataatgttcgaggtcttctccgccctttcctttatctgctgagaaacatggctcccctcgttccccgctcaccagtgggagtgcccactcatgaacatagacttttggatctaattggccagggtttgaagaccagctgagccacttacaagctacgtgggctcagaaaagctgcttaacgtatctcagcctggtttcctcatctgcaaactgggatgaatagtactactggcagggttgtctgggggactgattaagatactgtgtgtgtaagcaggcacttgaccgatactcttgccgttcccactgcccacagtgcctccaacccctgcagtcccatttttttgtgtctggctgtggtcaaccgtcatatctgagatgagacctctatctctgccatgaagggtccctgactctccaagactacaggttcaaaggatctgcttccccaaaaggctgagcatacccctgtcattgggtttagtgtcctgggctaccatggcccattgaatcatctgttgtcccaccagctgctaaacacctgaaaaagagtcttatttgcagtaactcatttgctccttagcatccttggtttacagatgaaggaataaaggctcagagaagagaaatgacttatcaaggtcacgtggttaattaaatagaaggtggggcggggaactcagtctggcactttatgtaagaactgtgttttaataagggtcatcaacccaaggccttggtgatgatgaggacctcaggctcatgacaaaactgggcagggagatatatttggaaagggagattttaatgtggaaacggcttacagatttgtgaggctctgaggccctaaaatacagcaggtgtcacttaacctgttctggcacatcctacttgccaggccctgtgctggggcctttgctgtacctgttctgttctgtgtcactgaaattctgaagaaggatatggatccatgccatgtctatagaggaccatgaagctcagccatgtgatctgtccaaggccagagctggtagcactgaaactcaaattcagcattggccacctctgggagggcagggtcctcttccatcctgctctggccagtgggagggacaccccatgtggagaaggcctgccccaggccttggcctctaggaaggacgagcgggaagcagcgtccccagagacatatagacaagcagctgggtctcacaaactctggccaagcccttgtactgcgcagaaatcgcaggcactgtcgctgaaccagtcctcagaaatcagtaaagccctgggtttctcaatccaggtggcggcctcagcacggagccatggggtagcggggcatcttctcagaccatcaattctacttggagatgtagggaagaaaacaatttaaaaattcctaaagtaagttctgatacatgctatagcataagaatgtttaaaactcaaagaaattcattgactcttctctgtggaaaagcttaagaagttttgagttaatccaaccctcccacaaagcagaaagatagtagagtctgaggcatcaggtgacttgctcaagttcccatgatccatcagctcacaggacctggactcaggcttggaaaccagcggctttgtggtcaggaagccctggattccagtccaagctctgctgctgtgtaactgtgctgttttggcttgatcaattcctttctccatgccttagcttcttcaccagtaaaatggggcagctgtcttggcagctatagggattcctgggcccaccataaatgcccgcctccctgtctgcctctttccctacaaacagggtaaagaaacctatggagagaaaactcccacatcagcactcacatccccaagagggtagattctaaaatcttttctccgttggtaatgaaccatggcgccattagaccacaacatttcacgtagtttctgaaatcatcatccatatgaagatattgtgcttggaatcatctcacagtcaccggaaggctgaattccctcggccacccactgctttttgcggaggaaacagaaatgtctgaaaatagaacgtgaatcgatgcccccgacttgctgccgcaaagtgtggcaaagcccaaggagcccgcgccgcctctgcccctgcatggccccagacggctgggggtttccgggcagcctggagtaggatttcaacatctcaagctggaggtcacgtgcacagagcagccggtggcaaacggggaactccaggaagccaggctgtttcagagaagtacttggagctggggggcatttaggcaggagccgagtgaggtcagagggtcggtggcagccgtaggcctaacttgccagagagggaggcccagtctcagtgggtcactccttccaggagcagaggaacagcgtgacagcccagtggcggccaagtgaccgcccacagagcactgggcacccacaactctctttgcagatgggaacaccgagactcagggagggtgagtaatgtgcccccaggagttacccagctcagcagagaaaaaattggggttgcccccaccccctctgcctctcttggaaggaagtcttggcttcctcaggcgctccttccactccacccactgtacccacccacctaacatctaccaagcatgtctcaaccccagactcccagtatcatcttgtctgcttccagataaccctgtaagacaggcagggtaatcatgcccacttcacagatgagaaaaactgaggctctcagagaccatgtgacttgtttaaggcagaggctcaagtccaggctgtctggcccacctccccagtgtgcttcagaagagagcactagtaacagcacagtggccatgacattcctacatgacagcatctcagcatttccaaagtgttttcactgccaccctagcacccagccacaaacagccctttcctacccacaaccacggcataaccaggaagttgtctatccccattttagagatgagaaaatgggatgagagggttgaagtaacttgcccaaagtcacacagctaagaagtggcagatccaggactcaaacctaagtcctccaggtctccccatactcaacctacccatccacattgctggccagtggacgggatgaagatgtgggcgctggcaatggtgtggccactgcctccccggccaccaccaatgctctgggccctaaggccctgcaccccttttctctgatgaccactcagtctccaaggccatcctgaaagcagcttattgcaagacctgctggaggctgggcagccagagagtggatgagttaatgtaggtgggacaggacacccctggcttctctgccgctcttctattgcctatacacagctgcaccatgcaaacctggtgtgattgggcgaggagggaacagacactgggaagcccaaaggttctggaatgacattgcctgcttttctctccagtgctgtcagggcaagcccatgacagcagttttgggtgcaaagagtggggaagaaggtaaaaactgccatatacagagaggctggctctggggcatgtgtccttcatatttattctacaaacgtttaataaacacccaccactacacaggccctggctaggagctctcacacttcctccttcactcatcctgacaaccaacgtgtggggggaccccactctgtgccccaccaccatggcagacaggcaagcaaaatgggaacaggagcactgcacaaggagtctgcagtcatgggtaccagccctggctctaccattcatccacagatgtgtgacccaagcaaccccctgccctcagtgggcagaagcatggctggggaggacagccaggcctatacgaggcagggaggaacagggacagctggcagggggtgggggctcagtttcctgtgtctggccagaggctggtgcttttctgtcctctcatcagacctacccagagacggtagggcaggaagagaacgatttcctggactcctaccatgtgccagccctggccaaacattttcacatgtggtatcttgtctaatttctgtaacatccaagtgaggcaaaaacaggctcagagaagggaaatgacttgccccagatcacacagctagagcagggaggaactgcaagaggatagaaacacagatctgtttgctttcaaaaaaggaggggaagcttccccttcctttttcttctcccgggtcccctagcacctttgtcttcctcctccgcttagctagaatgtgttagcactggaggagcaatggaaccaagaggcaggtgtggaggaactcatctgcttcccacctttgcattctcctagcagggccggggtcccaagctgtctttccatggtgggagtgggaggtgctctcctgcggagtcctgacccatccccactctcccacccaccctatctcagtgactaatgggccgtgccgctgactaagctgccctcgcagggtgcacagtggaaacaaacccaggttccttcctctctaatcctcacccccatccttggcctggggtctctagccaggccctgtgttacacagagaggtagcccatgatacaggtgagtcacgctgaggctgcagccacctggatctgctgcctaaagaagtgctgccctatccatctgatttcccatggggcgtcgggatgagaaggggctgtggaaacgaacagcctgaattttcatttctggctcaaccactgattgtgtgaccttgtgtctgctgcttcacctattggagcagcctaaacatcccgatttgtcaaacacagggctgttttgaaaactagaagccatcctatctgtaggatgccagaaacatagtaggtactcagcaaatctgagcttttcccttcaactgtctaagatagactgagggctgaaggccaaggcatttgtttacattgattgtccaatgaaatgaaatgttttcctattcctgacttgatttgtggcaagataatgctttttagaattgattctgacttgtagtttagccctgaattctacaccattgtgaattggaccctgaatatatccagcctctacagccagaagttcgaggtggggctggtaccaaatcttatccacccaaccatctgtccatccatccatccacccatccacctgtccatccatacgctcatcttttcttccattctgccatctatctgtccaaccgtctatccatccatctgtccattattccatccacccatcctttcattcatccactcatccactcaatgattgaatccccagcatatgccagccacagcaagggctccaaacaaaaaagagcttcaacagcttccgcatactctgctgctgttgactcagacacacatcacaggcagctaataattacttttccattggtcggatgtggagaggaagagcactgcctccctcccagcatctggcttgctcgacattgcctttctctgttccacatgcaagtctcccagtgactatctttctcgtgaatacttattccttgatgaacagggtattccccataagagcagaggttttcactaaggtacatatccctaatgtgcacatgtatatactgcctgcctcatagttctaatggggatttagggcctgtgtggggcttgcagttgattgtactgtgtctatctgcccactgggtcagcataaggctttacacacaggacacacttcccactttagcttctctccctctgtcgcatcatcttgatccattttcaccatcactcccctcactgtctagaatttgcagtctgtgttggtttgagaatctgtgtaacaggggagtgaggagtgcagtctctaaagctgggcccctaggtttcatatccatcactctaactgtgtggtgtggaacgagttgctaaacatctctgtgtctgtttcacatctgtaaaatggggatcgtaacagaactaatttcatggggctgttgtgaggattaaatgagatcatgttgtttttctaatggtgggcaataccacatcatgagggggcatttttaactgtaagtggatattaggggatgttccaaaggctgcggtggggtatggggtatggggtatggggtatgggtatgccactgacagcatgaggcaggaaccagaggtgctaaatcttgcaacatgccacacagcctgcacaacaaaaaactttcccctcaaaatactaactgcacccctagtgagaactcctgtgaaaagggcctcagcagggcctggtacaaggtagacacccaccaactgtgagcttgccaccacgtaagctttgtaagtaaaggaaagaaccttgtctgtctctttcagtgctaccaaatccccagcacttaggacagagcctgacatctggcagacactaggtgaatgaatgaatgaatgaatgttacatgttcagtcaatgactggtgagtagctgtttggtgaaacatgtcaaatttaatcactactagtgtttgctatgcagctccaaaccacaggataaggagatggtgggggaacagctgcccctttctgaatgtcccgtcctatccttccttcaaggcctgagacccctggagatgacgctcagggactcgtcatttgtccttcactggtgaatactatctgactcataaaagcttctctcttctccatgactagaatgtgggggtaggatctgcctctcttccctctctggtcctgggtataggggacttggtccctagcaggctcagtagacttgtgagtggttgcattgaatgccggccatcaggcacctttgcgtaaatgtgggcaaacctggtcaagcagagtaattgggaaatggaagggaaatgggggagggagggactccctggatattctgagaagaggattcaccagaaatctcgatttctacccgtgtcaaaaattcttccatccttaggcacctcccctccttggtaacacatagaatctttcccttctgacttgagttcagaagccagccagcatttttttgttttttttttgagacggagtctcactctgtcgccgatgctggagtgcagtgatgcgatcttgactcactgcaacctccgcctccaggttcaagcgattctcctgcctcaacctcccaagtagctgggactacaggcgcctgccaccacgcccggctaatttttttgtatttttagtagagatggggtttcaccatgttagccaggatggtctcgatctcctgacctcgtgatccacccacctcagcctcccaaagtgctgggattacaggtgtgagccatcacgcctggcccagccagccttttaaaatttatgtcactgaacttttgctaagtgcctactgcatgcagtggaagagctgaatcaaactagttcctgcatgctggaggtgccagtctttggcgggtgccagtctttggccatgatcagggtgtgctggccagatgggagacttaggagtttatgtcaaatggggttgagttcctgatactcctcagaagctatgttttggtatttaatgtctaacggaagctcatgttcttgctggattttcttgtttgatttgcttttgtttttctgaaaattctactcagtcgatgtattgatcagtgagattgcggctaagcgtggttttatagggtgggctcattcaaggggtgaacaagaagacagttcaccttctcatggaacttacattccaacacatacatatctaacatattacattccaacacatacatatctaacatattacattccaacacatacatatctaacctgccaggtgcttccaagtgctgagaagcaaaccaagccatgtttgaggataacaggagtagaaggcagggggcagggggaagggtgggagaggaaggtctctgattaggtgccatgtgaacagaggctgaggaagtcaagaagccagtggcgtggatctcagaagagcttggatgtcagccagtctcaggattgtggttctggaaggtgtaagctccagccagaacctgggggtcccagcactatcaagggagagagatggttcctttccctcagtttcttctctctggactttgggcccaaatgactcagagatggtgactttctctaaccctctcaaaacccatactcaagacatttcccctttctctaacctaagtctgccgtgtcctttctcaccccactgggcaggtggagcacaggaggtcactgcccccacagatcacatggtgaaaaagcagccctaaggtgggaggatgctgaaagatgtccctcagggaactccagggacatccccaaagcagtccccataagccaaaagggctttagtctcctgtttgatcgttaaaagccatgcatgtataaaattctgctttgcaatctatgcatgtatctacccatgtggtaaaatatacatgtattcaattattcacctgaaagatgggccaggtctacactgaagatccactaggcctccaacactctgctctgaccctggagacaagggcatccacagtcgagagcacagggcagaggagacccctggaattctaatcgtgacttgctatagacataccacgtgtctttcctcgacagagggaggggtccctgtggctcttgggccccctttccaggcagctgatgtctctgaggaccccagtgaagggcaggatgacgtggatgataaaagcctgaattagagcagggttgtgggggtgggaatatgggaggaatgttctggccagaggctctcctctttccaccggagggaatataacacatcccctgagaaagcagatgcggctgtttcacaggcctccttgctgaggcttcagggcctgtcagtgaatcctagcagatctggtccctaccatgatgcctggcatcaagaatcctcaatcagtatctgttaaatgaataaatgaaggaatggtcaacgaatgaatggctaagtcacaaagcaccagcagccagcccctggctgagatgattctggggcacttctggccctaatcatgcattggcagtgcctccaccacccttttgttccactctgaagcaatcatttgatggactgcctgctgcccccatggtttccctctgtggctaatgcagtaaaaagagccatagattataaaccactaattgtatttagagaaaaaaaaatcttgccataataatgggtaccaaatgactgggtctctgctaatcacctcgcatttattatctgtttacttctcacaccaactttccatcaaccccgtttgcttcagattagaaaccaagggcttcaaaaggtgacatgtttgctggggaaatgggactggctgtgaagtcctctctcttctttgcttggcacaggaagaaagagcattggggacttgctcccctccccatttcaacttcccagtcacattccttccaataagaagaatctaaggcacttaaatgctatttatttatgcctatgagcatggggtgcaagagcttctgtccagggaagctatgcatggggatggcaggtcccaattgggcttcggtggctcctgactcaaggcacttgtttctaggctgctgtaacctatgagtggtctggtgtggggagacacatggcatggggcaatggcacttagctaagccaaactgcccaggtctgcagcagacactgttggagcttggccccttcccctgtctcttgtcatttccttgcactccagcctgacctcttggcctcaattttgcatgcacagaggactggaagttcttgggaattaatggctgccactatcactatctcagccgtgggccagccctcaggtaacggctgctgggtgcagggtataaatgccctggttccctcgcaggtgcacagagtagagaatgagcaagtcaggagggccagcatgtgacctggtgtaacagcatcacccccggctcgaggatccatgggtcagggagcatgaaatcaccctggggtcctacaaagtgggcactatgactcccattttgcagatgaggaaactgaggattcccacctgtgagaggcagcagcaggataggaattcaggcctgtcagatttaaaggccaaacacctgctgcaggagagaggcaggggagagggtaagaagctaagtgccaataggcagacctcagggctaggaagaagggcagtgagggtgaggggtggtacgctgggccagcacaggcattttattctgagaacatgttggggctggtcagtacctagagaggagtgctgcaggacacccccagctcccaactgatcctgccagttcttgccatgcacccatggcagtgccagtcacccaggacccaatctggcagctgcctacctccaaagctactggcaactctcacctgcatttctggcagggggatgaggaaagtggaaagaatccattttttcctgattataaaaatagtacatactgtgaaaatttcagaaagtataaaaagaaaataaaaatgacttatgatcccatcctagagatcaccaccattcacatgtgagtgtccttctggtagacctttttctagacacatatgcagtttgattttagtttttacatctatcagctatactacttttttcttttattgatatattatctgtatctttcaagtcattgaatatacacctatgtcaccatctttaatagctgcatagtattgtgttgtgtagatggctcccattttatgtaaatcaaccttactgatagactattgctggttttacagtaaacaatgctgctatgagcatctttaaaatagtgtctttctggggtcaattaagaacatggatcaaaaggcttaaaaggataccattccctttgacccagtgattccactcggaagcacttgatggtcttaaggcagtaatcagatggaagaaggccaccagcacggatgatccagagaatccagagaataggaaccagacagcaatggaaggatcccccattcttgagttaaggccagggcaggcacatggttcatatataaacattatatgtctttcagtcttgagtgcctggtgtggactaagcacctaataaatgaaaggtgagactggtcacaaatgcaaggtgggaagcccgtcagaagtcacggcagggcctttccacaagctggattggtgctacaaccctggaatactggctttaggttcctctgggtgaggaacttgtccctctcttgtccacccttgttactttccctcagcttcagggagagtaaatgaagaagccaggggctaggaaggtgaccagaaaccctagtttcatggaacaatgacataccaaagccacacatatctttgttctgttcatgaccatggagaggtcatttcctcatctctgccccacctccttcaactattgaatgggaaactgtggtccactcacctgcacaaagcaatcagggggcagcgctgtgaacagagactttagagtaacatcatcatgactgtcatcaccatcatggcaacaataagggcggttaacatttactgagcacttgtcacctgccaggtactgttctaagtgcttaggctatgctaatcttcatgctagctctatggcgttgatactatcacagtcaccattgcatgatggaggcaggaggctcagagaggtcacccagctggcttgctgaattgttggggtctgaacttagcagccttcttctaagacacagatattggtcagaatgccacagaccccctgccgcccaccagcggggtccttcaggcttcttatttggcctctttgaggcttgagtttccttgtctgtaaaatggggataccactttccatctcattggctttgaggactctcaggggagcagtgcacacaggaggaccaccactcagctgggctcagagtgtgtgtgccttccgcaagcatctgagacaggtgccacaaatgagggctgcttgctgcccacacaaagatgatctgcccccagtcaatatacacttgtctctctcttgtccaccctgttagagacagaacaaggggtctctattttcagtcatgacagggattccttctaaccctccaataggctgcagacagtgaatgtcacccactagaaggtataaaggcataaaaaggtatgatgggtgtaaaaagaggtttgtttgaaatttgtgacttcacacttggcactcctggtagggatgggtcaccctctggcatccatgaccatttacccatgagcccctctcacttcccctgggtgggtttcagcaaaggcaaaaaatgcatatgattcctgacctgagggtttcttccaggattcaaaggctctctggactctctgaaaccttagaaaaaattgtgtgtgtgtgtgtgtgtgtgtgtgtgatggagagacagagagaaggagacagagagaatgagaataattctagagagagggcctgtagctgtcaagctgtcaacatagtttcactgaggctccttcattcctaagaaaatttagaaatgctatgacaaagggttttccctgtgaaatgtcattacatagatcagccgtgtgctctctggcgcgaaatcctcccatcccctcaccccacggaacagagctcacctggggctcacatagccctaactaatttggtcttcattagctatgtgatcttggataagacatctcgctttctagcccctgttcttcccatctgcaaaacaaataagttggacttgtgagtggcttcagcatgtgctctacggagctccgggggcacaggggagagtggtgtggccttgggggtgaaatgtatgtgggggtcacctctgtccaacaacagcagctctagctctcacagaatctgcatgaaatgttacatgagcaaatggctctgtagcctaaagccaaaattgaaacaaaaccctggcccagttgatcacttggaacctttctggcttgtgaggtctgagccctgagcagcaccaagctgctctggttctgtaatccttagaggcggtggagcctcctggttaagagtcagaacctgggtggaatcttggctctgccactcattaagcgccatgaccttaagcacgttgcctaaaactctctagcctgcttcctcttctacaaactgcacacacctaccccacagggtctctgtaatgattaaacaaattaataaacctacaacacctcgccagatccacagcaagcacttgtaagtgttagcagctatcttctgtcacaacttctaacatgagtccacaaacatggaattcatcaacaaatggcagctgaataaacgagggagtgaaggaatgaatgactggagtccaaaattccattagttgattctctaagtgagcccactcaaagcattaatccaaggcttcctaagctccagtgtgtgcatcatctgggaaccttgttacaaggcagaatcagattctgcaggtctgggctggggctgggccttggcatttccaggttccaaggcgaggccattgctgctggactgagtagccgggccttggttcattgccactcatattcattagcttgtaggcttcccacctgcagttaccaaaccactcaagacccttgaaaatctctgtagattgggcactctttatcacctactgagctaccaagcccagtgcacttttttttttttttgacacgcgtctcgctctgtcgcccaggctggagtgcaatggtgcgatctcagctcactgcaacctctgcctcctggattcaagtgattctcctgcctcagcctcccaagtagctgggattacaggtgtgtaggattacaggtatgcaccaccacgcctggctaattttgtatttttagtagtgatggggtttcaccatgttggtcaggctggtctggaacttctgacttcaagtgatccatccatctcggcctcccaaagtgctgggattacaggtgtgagacaccgcaccgcacccggcccccagtgcacccttggactaggttcgtaagaacggacatgggcatccgtgttaaacccgaagttcatgtctaggctctaccatgcaatgaccggccaagtccctggtttctctggggctcagcatcctcacttgtaaagcaagatcagcaacaccctccctgcccagcccatagaactgctctgaggataaaaagtgacaacagatgggaccatccaggggccagaggtcgtgattaactggcaggctttatttccaacttctcctcttcaccctttgaattcatcccgagggaaactgacacacattttttttttttttttttttgcataatggcatgcaagggaagaggagaggaagtcagcctgctaaatttagcagatgcttacgccccctcacccagggctcagcccacgcatttcaccatgagtaggtgcctttctatatttaacttctgcctgcaccttccccttgagctctgacaccaaaaaccccaggaggatgtggtgaggagggaagggaagttcacgaaatgagcagggttgacatcacatgaggccccacctgcaccttcaggtgtgcgttcttcaacctttcccctgtccttctcttggagcttaagactcacccagccaaagtgtgaccagagatgctactgccctttgggacaacagcactcagtggtgggcaagggaccatgaaaagcccaacagaagtcatggcgaggcaggagagtgtctaatgcttcccataggcacagcactaggcccatctgcacaagtgaccaaagtgaatccacacaaaagcatcacacagatggtatcatactcaggctgccgatgagcaagtgggggccccaagagagggagttgtccaaagcctgtgatgggtggagggtccaaagcctgtggtgggtggaggatccaggcctgttctccaacatgaccctgtccatatcacatttgtcttctcactccaccttctttatagaagactgctggggaggtgatgggttcaagtcttacctatgtcatcactcaggggtgtgactttgagttagtccctctccttctctggttcctcactgcacaacaagtccactggactgcctttctgtttgatttccgaaaatcttcttgatgacatcagaatccaacgatcagaggaagtgagaatgaatccggatgactgactttcaaaaccacagggtgacctctgtgctgcacctccctggtcagcacacatggagtctgtggcagtcacccacggaggctccgcaatagctcctcacccttctggggagccctcactgaatgcctctgtgccaagcagctcagcaggctctgggtggactgagatgaaccaggggcctagaccagggtccacctccaaagaggggaaaaagaccagggaagactgcggctctgactgtgatgtggtcagcacggcgatggagctcccatggggcacaggggctggtgcctaacccagcctagggggctgagggaaagacccagtgggaggcagacaaaatacatccaacactccaggccagcagttctcaaagtatggttcctgaacccggagcatcagcgtcatctgggaacttgttaaaaatgcaaatccctgggcctgtcccagaccgacagaaccagcagtctgtgtttgaacaagcccaggccctccaggtgattctgaggcactctcagtttgagaacccttggcttagggcaggccttagaagacagcaaaaccttgaactctgacctctctgggttctattcaaagcttggctaggaaaagtaacaattcaggaaagtgttctaaataatctggcgtcccttctctccgctggacaatctcagtgctcactttacaaagtgttaggctcagggaaagatccacatctgagtctggctactagcctggctgctgctccactggctacatcgctgggcactgcctttgggttttattgagcgtgtttacaaccacagaaagactgtctctgagttgctgtaaagcggttgtattctatcaagttacacaaaactccttctgtaaaaactcacgtgagaacagtggcaggtaacttggcaaagactttctaaaaatgacaagacccagcattggtgggagtgtagggaaaaagacacagtcacacatttctggtaagtatggaaattgatactgcctttctggagaaatacctgtcaaaagtgtttttttaatgtgcatccccttgacctagcaattcaatcttagaaattaatcctaaggaaataatcatgactgtgtatgagtaattcactccaaggatattcatgttagcattgtttgttttaaaaattggaagcaatgggccgggcacggtggctcacgcctgtaatcccagcactttggactttgggaggccgaggtaggaggatcacttgaggtcaggagttcaagaccagcctggccaacatggtgaaatcccgtctctactaaaaatacaaaaattatccgggtgtggtggcatgtgcctgtaatcccaactacttggaaggctgaggcaggagaatcacttgaactcgggaggcggaggttgcagtgagccgagatcacgtcatcgcactccagcctgggacacaggagagaaacgccgtctcaaaaataaataaataaataaataaataaataaataaataaaaatagaaaacaatggaagcgtttctaatgaggggctgtttactaggtggccgttcattttcattcattcaggtatttattgagcaggcatcatgtgccaggcagtgtattagacattaggcatacagcagccggtgaatgaatgaacaaaatctctgtcctctgggaggggagacaaccagggaaccagtaagcaagtgcaatatccgttgtgggtcagcgggtggtgggggtaagaggagaaggcagcaaaggcaatgctggaggtgagtgccgatggagactagagggaaggtgaggaagtgagtgagctctgtggacagctgaggaagacattctgggcagagagaactgtcttccagacagaaggaaacagcaaaagagcaagagcacgcggcattctgggtgggtctgaggaacagcaaagacaccatagcggctgccgcagggtgacccagcaaggagagtgggacctggccatcagggtcgtgcaggaccttgcaggccacccaggacctttggctttcactctgggtgagaagggaggattttgagcagaggaggacccctgatttgtgttttagaggcaaccctctggcttctgggtggtgaagagactccactgccctttgagacaagagcacaggagacaaggatcagattgcaatgctgttgggaggctatcacaacaatagtctttgcatgctagagatagcagcaagtgagccaaggtaatggcaatggaggtgagaagtggtcaacttttgagtacaatttgaaaatacgtttgggcttttctgcagagcgatgcctgcctgccgtacgtgtggctgcctggacagacgacttagtctccagaagctgagatgagcgacaataagcaaggaagagagggtgcaatataccttcagagggaaaaaggagtcagcaggggtcgccacacaaacctgcctgctcactctgttggacatttctgaaacctcaaatgtgaatcttgatatcaccaaggtaccaaactcttctactcagatctgggggcactggctgcctgcttaggttcaaaggcaaccaaagaaatgcaatttaaaataaggatgtgaataatttttcagttatcagataggcaaagattttttaaaatgataacagccggggttggtgtgggtgtatggaaacaagcgcccctacactgcagcggaagtttaaattagtaccacctttcaggagcagtttggtaatacgttatcacaagccttgaaaaagtacatgccaaaggaaccagaacactgaaacaattttgaaaaaagaaaaataaggtgagaagcatcactttacctgatgttaagacatgatatagctacagtaatcaagaatgtgtggtattggcaggacagatacataggtcactggaaacaaatagcgaacccagaaatagttccacatggctacagccaaccgagtttggacaaaggcaaaaaagcaattcaatgaaggaagcatagtttttttttaacaagcggtgctagaaatattagctatccataaggaaaacatggacctcaatgcaaaccttccactttatacaaaatttcatccaaaagaggtaatagatttaaacataaaatgcaaaaccataaaacattcagagataacacaggagaagattttcaggacctagagcccagtgaagagtctttaggtgtgatatcaaaagcacaatccataaaagaaaaaaaatccacaaaattgaatttcatcaaaattaaaaactgcttcgcataagaccctgttaagagaatgaaaaggcaagctatggactaggagaagatatctgcaaacaacaaatctgacaaaggactcatatctagaacatacaaagaactctcaaaacacagcagtcaaaaaaaaaaaaacacccaaaacaataaacaatctaattagaaaatgggctaaagacatgaatgaacacttcaccgaagaggatatacagatggcaaataagcacgtaaaaagatgttcaatgtcattagccattagggaaatacaaattaaaactacaataaaatacccctacatggctattaaaacagctaaaattaaaaatactgacaataccaaatgctggaaagaatgcggagaaattgcatcccttgtccattgccggtgggaatataaaatgatatagctacactgaaaaatattaatagtttctcagtttctttaaaaaaactaaacatacagttagcataagacctgacagtaatactcctgggcatttatctcaaacaaatacaaattgtgtgcacgtaatctgtacttgaatgctcacagcagccttgtttgtaaaagccaacaactggcctacaataggtgattagttaaacaaattgtacacccataccagggaatactactcagtgattaaaaggaacagactgttgttatacagatctcggataaatattaagggcaatatgctgagttttaaaagccgatctcaaaaggtcatctaatgtatgattatagagatagaggacaaaccagtggttgccaacagtcagggatgactgggggatgggaaaagtatgactataaagaggagcagtaagaagatctttcaggtgatggaatagttctgtatcttgattttggtgaatctacacatgtgatgaagtaacgtgataaaatgacatagacctgtatgcctactacaatacagtatcaaaaccacggattgattcctggttctttttccaaattccacttttacaaacttatcctaaggtaatattaaaaaggcaccaaagagccctagatccctggataaacaggatcatttcaaagttgtttataacagtgggaacttagaacaaacctcttcatgccaataattggttaaatagactaggataaatatatccaatggaatattatacaatcattgaaatgatgatgtagttctacattcgttgatatggaaagactttctcaatatactcttaaagggaaaagattacttaaaagcaccatatggttctttaaaaaataaaaagttatatgaatatatagactgcaagctccctgagggcaaggatttttgtccgtatcatttactccagaatccctggatctcagtatagtgcctgacagaaagtaggcactcaataaatatttgttgaataaacaaataatatacacacacatttgcaaagtctagaaagttattctgcaataaaatattagcaatggttggctggggtcagtggctcatgcctgtaatcccagcactatagagggcaggatctcaaagaggagggcggatcacttgaggccaggagtatgaggccagcctgggcaacatagcaagaccttgtctctaaaaaattattattattattattattattattattattattattttggagatggaatctcgctctgtggcccaggctggagcgcagtggcgtgatctcggctcactgcaagctctgcctcccaggttcacgccattctcctgcctcagcctcccgagtagctgggactacaggcgcctgccaccatgcccggctaattttttttgtatttttagtagagacggagtttcaccatgttagccaggatggtctcgatctcctgacgtcgtgatccacccgtctcggcctcccaaagtgctgggattacaggcgtgagccaccgtgcccggcccaaaaaaatatttttttaattagctgagagtggtggtttcacctgtagtaccaaggaggatcacttgagccaaggagtttgaggctgtagtgagctatgctcatgccactgcgctccagcctgggcaacagattgagactgtgtctcaaaaaacaaataaacaaaaaacaacaacaaaacccaaaacaatggttatctcagaataggggaatggaggaattttggttgatttggttgattaattacagccccttcagtctgtttatattttctactttgtatttatttatttatttatttatttatttatttttgagacggagtttcactcctgttgccctggctggagtgcaatggtgcgatctcagctcactgcaacctttgcctcctgggttcaaactaacctcctgcctcagcttccagagtagttgggattacagggatgcgccaccacacccactaattttgtattttcagtagagacagggtttctccacatttgtcaggctggtcttgaactcccgacctcaggtcatccacctgcctcggcctcccaaagtgctgagattacaggtgtgagccaccgctcccagcctactttctactttttaataacaattatatattctttatggaatatatatttttgaagtacacaatcacaaacaaagtggagaatgtgctgtggagatctctggcctgattgggcaaaggtgggggtggtgcagttggatgacatccaaccaaggctgccttccccggacaggttttggtggggtctgaagaccattcccagggctctggtgtgagggacactatgtctggagtgagaaccctcataagagatcttcacaatagtgaggccccctataagccagagagatgatagaatgatgagccaggtacacagggaatggggagagaaggcatcagtcctggtccaaatctcctctggagaggggctgggggaggacacaggacagaaacctgcagacacatctatccaccagggcctatcttatgcacagccttccacgcttcaatggaccaaggtagtggttcccaaaagacctgtctgaagacaggctgcatcacaattcctaggaagctttataaaatatagatttccgaccttggaacccaagtctctggggaccagaacccaagttctagagaccattgaacccaagtctctgggccgaggcccaggaatgtcattttacaaattccttgggtgattgtgatacattgtggggtttgggaacctccaggcagtgggcataaagccaaaacagcatcatgttggacaaactggtagtagttatgccatttgtgatgaaaggatatgggaactagcagtgattgatttgtaagattttctctgaagcactcagaaaaatttaaagacattgctagaatcttagacacctcccttttaggagaatggggggtactggccccactgctcccccatagtgtactgtgaccaatgactccctcactcccatcttttttaaattgtcgtaaaagatacataacatttgccattttaaccattttaaagtataaaattcagtggcattaagtgctttcgcagtgttgtgcaaccatcaccactatcaaggtccagaactttttgatgactcaaatggaaattccataatcattagcagtaactccccatttccccctttccagctcctggcaaccaccagtctgctttctattaggttggtgcaaaagtaattgcggtttttgccattacttttaaggtcaaaaactgcaattacttttgcaccaacctaatatctctgtagatttgctcattttgggtatttcatataagtggaatcacacaatatatggccttttgtatccagcttctttcacttagcatgttttcaaggttcatccatgttgtagcaggtatcagaatttcatccatttttatggctgaataatattccattgcatggatatattctattttgtttatccactcatctgttgatggagatttgggttatttccaccttttggctattgtgaatagtgctgatattgtgaatagtgcagatatgagcattcatgtacaagtttttctttgaatatctattttcaaatctttggggtatagacctaggagtggaattgctgggtcatatggtaactctatgtttaacttattcaggaacctccaaaaggttttccacccacactcactcttataaggcatctgatacctcagtctgtgctctggcacaggcacccaaggcatcccagtctgtgccttggaagcctgtagcagagtcttagggtttaaaagatctgggtgtaggtcagactgtgattctacaagctgtgacaccatgggttggtcatttctttgtactttggtcatctttgtgctttggtttccacataggacctcacagggtggtctaaatattgaatcagataataagtgagactatggataaaacgagaggtgccatattagagtagtagggggtaagggctctacctggccctattgttcagtgatggtaaaaccttggtcaatttcttatagcctatgcttcagtctcatctataaaatggggtgaataagctgggcatagtggtgcaagcctgtggttctagctactggggaggctgaggcagtaggattgcttgagcccaagagctggaggctgcagtaccccatgatcacacctgtgaatagccactccatagctctagcctgggcaacatagtgaggccctgtatttttaaaaatgggatgaataagagtacctgcctcataggactctagtgttaaaacagtcaattcatggaaagcattcactggaaagtggtaccaacttagctactgctagaaaatgcttagcaatactggtgggggccgggggactggtgctcacattttcagcttgcacctgggttcctgccctccctttctcaacttctctacttctgtctctgggcttctctgctgggacccttctctctcacgtccacaggtcaatgcccagcctgaccccttggttaatccctcttctgtgctccatgccctgcagagcttactttgctgagtttgacttgagtgtagactctggcttgttcattttatggatcttctctagggcctattatacagtagatactcaatagatacttgctgattgaataaatgaaagaaaacatttctcttcaactggggaattggctcatggggctgatcacagtacagggccctggggcttgggggccctctccacaactaagccaggagcatgcccaaatgctccacaatgcctctccccagtttcacagtctgccaaacagcacagtgagaggtcacttcaggatctaggagtgagtggggcagagcagtgacaaggcccagccacctggtctccccagccttcctcagctatcttgggctcagaaagtggtgatgggtaggcatggactctcctcccatgaccctcaaacatgtcccgtctgtctccccactttacctgtcctctcaaatgtaggccatttgagcctacactcagctcccttctcttttttggaaataaaagatgctctgagaagaagtgtacattgccagacatggaggcactgaggcctgccagtctggtgagagagactacagggcagagagattacagggacatttggaaggaacattgctggtgaaggggttctaaccaagagcagtccttgagctaggtgtatgcgcatgcatgtgcatatgtgtatgcacctatgtgagtgcccaggtgtgtatgcatatgtgtgtgtgcacatgtgagtacatgtgtatgtatgcatgtgcatgtgtatgcctgtgtgtgtatacacctacgtgagtgtgtgagtgtatggttgtgtatgtgtatgcatgtatgtacctgtgtgagtgtatgagtgtgtatgcatgtgtgtgtgcatgtgtgagtgcataggtatgtgtgcacatgcatgtgcatgtataagcatgtgtctctgtgtgtatacacctgagtgtgagtgcatgggtgtgaatgtgtatgcatgtgtatgtgcatgtatgcttgtatatgcatgcacctgtgtgagtgtatgagttcacaggtgtgtatgcataagtatgtgtgcctgtatatacatgtgtgcatgtatgtgtgcatgtgtgtgttatgcttatgtaagtgcatggatgtggctgtgtatgcacatgaatgtgcatgtacacatgtgtatacataagtgtatgagtaaataagtgtgtgtgtgcatgtatatgcatgtgttcatgtgtgtgttatgcctatgtgagtgcatgggtgtatatgtgtaggcacatgtatgtgcatttgtgcatgtgcacttatgcacccatgtgagtgtatgagtggatatgataatggcaggaggcagacaaatcccaaggcagacaggggcagatccctagtgaaaaactgactttcaaaccaaagacagtttaaagcctgaaagccgagttacaagtcccaggtaaatccatggactggattgagaacctctctttccatttggcgtgctttcctctgattgatccccactcctcacctattttacacatacctacccttccctaattggttttttacactgtcatgctcacctttgagtggtgcctttgttttagccttttttgcatacccacaaaccaatcagcatgcactgctccattctgagcccataaaagccccggacccagccacattgagggagagagaccacccaacttcagatgggggaccaacctcacatcccctctctgctgagagctattttgtagcttaataaaactcttatatgcccttctcacccttcaactgtcagtgtaatctcattcttcttggatgtgggacaagaacttgggacccactgaaggtaagtatgaagaaagctgtaacactgtaaccctcccattctccatcagcagagggcagccaccccatgcagcaggaagcagtgtcagggtcaggccagccctggatccgcaggctggagcagggcagtggactaaaggagctgttagcatgctctaacacctgctctggggcttcagggttgtgggcatccccgtttgggtgccaccgcattcccctcatctggaggccagagtccaccacagcagtcggtcatgacatgcctggtccaaatgcaagccccacacaaagcctgctcctgtgctggcacttggagcagctagccggaccccacacttgcttgctcacacacccacttctgccatgggctgagtgcgctgtccttgtggccatgggatctgcgctggagtgcaagccaggcacagcctggtggtttgagtgagcaggggcatcaccagccatgaaggtctctggctggcaaagcggcactgaaaatatcctgcattagataggcatgtatgtgtatgcatgtgcttgcatgttagggggctgagctaggggaataggtggaattggccactccttcctggatgcccaccagcttaatttcacatgtgcagccaggtctgggcagctgagcctgcaggcctgccaaggtgactggggaatgcctgagagtgtgaacactaatacaaaagccagatgccaagtgagaggagagttcacacatcagagtgtcatggtcaccttgggcaagtctcttctctggggctttaatttcctgcccatcaaataacaaaggggtcagagaccctctttttcacattgcattaacatctctgctaagagctgctccagcatgctcaaggagacatgctgctgacagtccacccctctctcccgaggctctgtttgctgaggacatgggctggcaactgaagagagcctggaatcctggggcaagcactatgcccagctgccgtccccctcctgccctcctgcacaggggtccccaaacctttccccaactgccacactccatctggctgcagcagcagccatccagggagtgctcgtcctctctgagacctgcctggctctcatgcttgcttccattcaagttggatgccccacccctgggaacagccctgacttcatgtcccctacagcctaagcaccgttcattcactagactggtagtctccaaagtatagtatacaccattattgagcataggaggaaaataccagggctactatttctacttatcacatccttctgcaaattcctaatttatatgtgtatgtgttagtatgtacaaaatatatcatatagtaatgctggagtacgttctcaaaaatacttttactggaagagtatgcaattaataaagtttggagattgtgttagtggaggtaaaatacacagaatgacgataactacaatttggtgtttggtgacaaatgtcacaatagaggtgaaggttaaatgctgtgaaagttcaagaaaggatgtaattgctactaactaaagtgcaggagaagaatcagtgaagacttcatcagaggattgagtttggggctgaatcttaaaagataggatgtggccatgtggccatgggaaggaagggctctcccagcagaggtcatcacataagcaaaagcacagggctggagagcagacaagcacaggacagatgcggggcccagagccctggtgtcccagctatagatgggaaaagcagtcggatatgagatgggaagggtgggttggggacaaatgatagagaagggactctgaataccccagggatgtgtggggaatgtgcacaaaactgaaaaaaaatgaggggagccaatgaggattgcttaggagggaagagacatggcccaactgtgtttggagacttttaatctaggaggggagtgtaagattggaaaatggaaggtgaccatcatagcccaggcaggagggcctgaaatcaatcagaaaagaaagggaaagaaggaggcaggtgtaagaaacatcgtaggagcggatttaactgagtgccttcactgatgggacaaggtgcgggtggggggcatgaggacaggagaagcgaaagataagtcaaccttcaatgctcagtgaccagagggacagctgcagagggaaacctgcaaggaaagttcaggttgtgaggtctgtctccattgtctagaagtgacaattaaaggataagagtctgggtggttggttgattttacaaaaaagatgaattcgccaagggctaaacctgtctgcacttttgatggaaacaggtctttatcttcatttgacaaacatttttgcatccctcctacggggaaggcatcatgccaggcactgggaatgtagagaggaaccagaaatactgcccctgtcctcaggggccctcagtagagaagggaaactaccacacaaagaagtttttgacaatccgtcagctgagtgctccaacaagaggccagaggagggttcatggcagtgacgctctccctggctcggcagccagagccatctcctgagaggaattccaacctttcttcacaactcagggccatcatcacaggtgggggtggcatgggatagatgctaggtgcccatcaccttgcatttttagagaaaactgtcatgtcaactgtgtcaccctttaccaagcaagccaacctcagagtgcacagcaccatgaatttggatcttgcaatctcttttattcttgcctcttgagcttctttgacctccctttatttttggatttagggggctcccagaaatttggtggagaggagagctctagatttctgagtgtactttggcttattttaattaattaacgttttccctcctggccccatcagccttgttcctttttcagacttcctcatctccccagctatttataaacccctgttcccttggcctatgactttgttcctttctcactgttgaatattcatgctgtaaggtctccccagagagggaggtccccattatctacccaggctcgtctgatgttgtttaaccccgatgtgtcctgaaacttggcagagtagaaacagcacaagctctcaagtcagccagatgtcaacatctggctcctcccctgttgtttgagtgtctttgggcaggtctccaaggatcagcatccttaagaataggatggttcaccatactgttccctctttgtttggaagttaacctttagtgttgatttattttgtatttgagtctcaaatactgtattggtaaatttaaggaaagaagaaaacagaaattagcctgtaagctgtaagccttagaccttctaagcaaggtctaccctatatattatcacaccaccttcccaatcccctggtacaacacttggcatacagtaggtgctcaataatgtcaccccctccatctttcctatcccattgactttccccccacctgtttgatggttttcatggggtccatatgtcacagaatgtccctgccctcaggcagtagggacttcatgttgtggcctctctttgcggggagcacccctgtctggggtgtgcctgctccttctttctctccagctgtctctctgagcctgccctggcccacgctggctgacatacacctcctgcactgataactatttgctgctgcacttgcccctagctgggcttggccgctgctgcagagggccatcctctgcctcacatcctctgatgagtcctgggcaggttcaggtgggccctgggcctgagccatggtatgtactctctggctgcagccccaccagaaaaatactcactgtctgaagaccagcacctggaggctctggagttagtgcagtgctttcaactgggggtgtcttgcttcctctgattcccaggggatatctggcaatgtctggaaacatttttggttttcacaactagaggttactactggcatctagtgggtaaaggccagggatgttgttaactatcatacaaggcacaggacagccaccccacatcaaagaattattcagccaaaaatgtcaatagtgctgagatttaaaagctttgggcagtgtcattaaacataacaatacctgccattaattgagcacttgctgtgtgtcagaggctgtgctaagtactttacatgcactttctcatttaatcctcaccaccacggtatgagacaggcagtgccattttcccattgtacaaatgaggaaatagagagactgaaggtgaactcacttgcacaatgatgcacagctaatcaatggtgtaggcagggtttgctcttgtgtgccgctgggcacatctggacagcacctgcatcaccaactccctctctgctgtgttggctcagtccagtgggcagtgcatctactttggttttcctgatgagcactccattctccactaggcttggagtctggccagatccacttaatggactccaacatacctccaaacactctcagccttgtggaagccatgtcaagaatgaacagtctcttggaagtgtcacagagctccccatctgtctggcctccttcctgctgctaagcagtgccccaaccaaccccgcaggaggaaagactccccaaaattgtcctacccaatggatactctacaccaacccgcactagactacagctttggcagctggctgagatcccagccacagttccactcagccccagatcccacttcctctgccccatctgggtcctgtgtggtccacaatggttcttactcaggtcctgaacctctcatcttctgtctgacacccacatctcatcaaatgcatcatctgggcatccttatgcaccctgattccatctcctatttggactcctccctctgggccccaagattccttccacattttatactcagttccactcaaattctgccaagctttcactaggaaggaagcactgtgctggggattaaagaggacacagaatcaaagcagatacagctcccccaaccgctagagctctggtttcatggcgggagtgaattttccacaatgggatcacagtaaggtaggctcccctcctttagggacatgcacagaggcagaggtgtggttgacctgtgagcagctgaggcttcccagaggaggcaacactgggaagaatgagggtgtgggccccaccagttctgatactggagagttccagggtccttctgcagccctgcctttgtcctgagggcctggctgtcacctggctctgtatcaggactcatggaatcttagcctgcatttttgctgtgcttcccagagctgaaggactctcccttccaaatacccgcgaacaagcacactgcttgacctgcttctccctcactcagttcatgcagttgacttatctgcatatagtgcctgttttatgtcaggaacccagcagcagctggagtcacagattctctgagctggcagggcttttgttcatctggcccaaacttgtccatccttagtacagtttctttccactggatcgtgtttgtcaggaaatgaacaagaagcctcaggctgagtttgctcaggattcatttttacctcgttcttcctagttctgcatttgttccttataacaatccttcatgctcatgaagccatgatggattgtagatgtagatggcagacatcattcattgtcatttacagatgaagaaacggaggccaaaacactaaaagcactgcattccaggcctagctctgtggctggctgctctttcccctcaagctgacaccatctgtattagttcattttcacgctgctgatagacataactgagactcggaagaaaaagaggtttaatggacttacagttccacatgactagggaggcctcacaatcatggcagaaggcaaggaggtgcaaatcacatcttacatggatgacagcggacaaggagagaaagcttgtatggggaactcctctttttaaaaccatcagatctcatgagacttattcactatcgcaagaagagcaggagaaagacctgaccccgtgattcaattacctcccaccaggttcctcccatgacacatgggaattgtgggaattataattcaagatgatatttgggtggggacacagccgaaccatatctccatctaaggtaagcttcttttggagacccagttagatagttctaccaatctgtaaatttgtggaattataaaaaggtgctggaattgatcttagcagtacagcagctagctcctttgacgtatatagacccttgttaaccagcttcccttgttggggtgtgaaacccccttcgtggggataagaggaactcttctcgcaggctgggaggaaatctaccagtccagaagaggaactgccttcacctcctctacactgaggagttgctgcttctggtcattcacagagaggaagctgagggttttttgcctatgctattccaaatttaatgtaaatatttcactgcaagtctaaaacccgccctgttggctttgcttggcctaaccagaagtatttcagtgcaatctgatctctgagctcagggctgttcctcaggacctcaggccgcatccggcaggtctccccacaaggcttccattccaacccttacagaaaagagtggccttgtgatattatgaagcctgccaatctcatgtcccttgtgctgcagaagcacttggccagcgtgttgcaatgcaagcgctttctgatcaatatctgttagcatcatggccctaagcagctaaaaatcacacaccaaatggttcccttttgtagcaagaatcatttcatttgctccttgactttcaggtaccttggacactaaaacaacagtgtatcaaaagccagccacagaaatcagcctttacacttgcaaagcattgtccactttccaaagcacgtgcacctccctcagcccatctggccaaccctacggggggttagtgactcagggttactgctacattaagcaaagggtcatgtagtatacaatcaaaaagtaacttcacttttatctccccctgtcccactaaatgtgtccagaagagctggctgttctctgccctttggaagaaatctagggcacatcccatgatgttttccatccctctttaggtaattaaaagtcttctaggaaccaagattccttagagaaagcactgattctaaggctagggctcagaaaatacaagaccagcctggagaaacttgtagtgccagaaaataagaaagaagtaaaaaaagaagttaagaaggaagaaaggaacaaaggaaggaagtaaaaaggataaaacctctaacctgaaaaagcttccaatgatcaaaacatccaatgactgatattccaaaggtagaacaatttgagtaacaaaataaacaacaatagcattgtattatgactcaaagaataaaaatctttgggtcaatactaatgtaaataatgtattgaataaataaataaatggataaatggggagaagggacaactctttcttacaaaagaattctaagtaataaatgaaaaattgaggaaagtagaaaaatcactcttagaataccacagtaaaaatggcagcaggcaagattcactgataaatgctaaaattgttttttgtttgtttgtttgtttgttttttgagacagagtctccctctgttgcccaggctggagtgcagtggcacgatcttggctcactgcaagctctgcctcccgggttcacaccattctcctgcctcagcctcctgagtagctgggactacaggcgcccaccaccacgcccggctaatttttttttttgtatttttagtagagatggggtttcaccatgttagccaggatggtctcgatctcctgaccttgtgatctgcccacctcggcctcccaaagtgctgggattacagatgaatgctaaaattaaaaggtaaagctttaaggagaaacaggatatctgcatagcctcaacgtatctcccccagaatattttctaatgactgtggtagttttaacacgtgtccgaaaatgatttgatattcctccctgcagcaggtggagcttcgttcccctgcttgagcatgggccggatgtattgactggcttctaatgacagattatggagaggggacaatagtgacttcgcaatgaacccggcagataccaccttagccaagtgattaacataatgagcaataaatattattgttgtcatgcgccccccaatataatgcaatgagaaggggacagcacttctaccatattttccctcaaagtccataacctcagtctgctcataagaaaacattacgcaaacccaaggtgaggaatgaacattctatagtatgcccgatcagtatgttccaaaagtgtcaaggtcatgaaaagacaagaaaagactaactgtcacagaatgcaggacactaaggaggtatgacccccacccccaaatgcaatgtgcaatcctggattggatcctgttccgggatgctgttgtgctaatgttaatttcttagttctgacacacctaccacagtagctttgtaagatggctacattaggggagacagggtgaaaggtacaccagaactctctagagcatgcattgtcaacggggcatttctcccccaaggggagaaaattgtctgttgggtagaaaaaaaaaatcacaatggtttgtggccctctaaagggccacagtacataaatagatatccagcatatctgtgggactaaaattttatgggagaaaaatcatagaaataaacacctaaacagactcctggggtgggagtggagcaatgatgaaaataaaattggttgagaaatcctgctctagaggtaccatctttgcacctcccttataaatagaagattatttcaaaaaataatttcaattgctgtttctaaaagttggtctgtgaagaccttacctccccacctccccccacccccaaaaaattaatttactaaaaaataatcctctggtcacttgtacctgtaaaacagtttcaatttagtaattaataaggctgacctggagtaataataataggagaaaagaagttaaactttagccaaattaaagcttctctcctccggagctcaggcctgcctcaagctggcccctgcaatgggaaagcagtttaggttgacctcttctctcctctcctccctgccccgcgtgtctacccctccttgctgggctgccgctggctgctttgtggttttggcaggaggggctggaaggggtaaggaagcaggaggagttggatttgactgttgctctcaggaactgacagtactctcggggcttggcaggtttttttgttttgttttgttttttgagatggagtctcactctgtcgcccaggctggagtgcagtggtgtaatcttggctcactgcaacctctgcctcccaggttcaagcgattctcctcagtctcccaagtagctggaactacaagcacatgccaccatgcccggctaatttttttgtatttttagtagagatggggtttcaccgtgttagccaggctggtctcaaattcctgatctcgtgatccgcccgccttggcctccaaaagtgctgggattacaggcgtgagccaccgcacccagtccctggcaggttcttaagctgactctccctctcttgggtccagtttgggtttttcagagactcccacttgccacgagcggcctctacctgcagctgctgccgcgagtgatgccacctcaagtaggccatgcttgacctcctggttctagtggtcactcttaccagaagccactaaaaaggcacccagggttgtgcattcactctttgcaccaggattcctctatacaccaggaaatctacacttgggcatgaacagggccacattcagtcccatttgccgtcaacaccttccatcttctaatcatgtggaatcctgctgagaggagaacgagagctgggatgaactaatctcttcatggctttttggggacatgagatgtgccctccttcctggtgcatgacaggcacatttccacacaggttaagccagctgcaggtgggttttctggcacttgcagccaaatgcatcagagctctcaaagctaatactatgatgcacgggagaggtggcagggaaaggaacaaagaacaacagaagagggaaggaggtggcagccatcagaagctaacagtgaagaaaaaggtggaagaagccatcggcatggtttcagcagacccgatgtggagatcagtgacaacagagaacaaacaaagaataaaatagggccaggcacggtggctcatgcctgtaatcccagcactttgggaggccgaggtaggtggatcacttgaggtcaggcgttcaagaccagcctggccaacatggcaaaaccccatctctactaaaaatacaaaaattacccgggtgtggtggcaggtgcctataatcccagctactcaggaggctgaggtaggagaatcgcttgaacctgggacaggttgcagtgagccgagatagtgccactgcactccaaccggggtgacagagtgagactctgtatcaaaaaaataaataaataaataaaataggacccatttgtgtacttactgtctaccaggcactgttctgaacactgtatgtgcactgcatatgccccacagattgacccattttatggagtttacaggaaacaggttcatggaatcagtaagtggcagggctaggacccaaacaatatgatcaagttcagatgtagattcaggaaacacctactggtcagccagatgctgtgctgggtgcttccctcacaaggccccatttcatctaaatgccagctttggaaggtgtggactatttactgcattccacaggtagagaaactggagcacacaagagtgaagtcacttgccaagtgactggtggaactaagcccagaactcaggtcttgtgattcgcagttcaatattctctctgctgggcaaggctgcctttcctcatctgcaggaatgtgaataaaaacatcacacagggatggcgttcagtagggatgtgctgaaatgactgtactggttgtgaaagtgctgaaatgcctctgtaccacttggtaatcagccaccgctctgagcatcctcaaacgctgccctggctccttcttcccagacaccctcccggaatccagtatctaaagaattttaactgaggcctccaagatgctgttttggtgctctggcacacatccacttcagccaattggtaaatgcttggaatgtcatctctaacaaccatctattcctctggtgcttcattccttcctaagcactcttgtactgttacctcctctgatgtgcacagatgagaaagctgaggcccagagaaagtaaaaactgcccgaggttgcctggtgatgctgagttgagctaggcttaagccaaagtcatctgacttctggttaagggctgtctccattctccagcttttagtcagttaaatagaaaattttatactaggtagagttaagaattctaaaatagataaaattagaacatgtcacagatgaaggacaagtctttgtgaatgagatttgtcaattaaagacaaaatcaatgctactggcaaagattcagtaggcctgagttaaatgtaacactcttgcccattgtcatgtgacctgcctgagcatcctaggagcagatgcttctggctttggacttgaccatatgacactttccaatgagatgagaggggatgtgctgtgtgctgggtctgaggcaaagctgtttctagtgattgtgaggttcaggacagtcactcctgcacctgcctctgcaacaagagaacagcgtgtctcgggtttggctgcaccttctgccaaggtccctgaataggaaggcatacggggccttcagagcccagagatgccaccatcctcacatcatgtgagtaagaaaatacatgtttattttcataagttattaacatagtgggttgttttttctatagcacaagctgactgatgcactgggaagaaagaatgctttgaaaatttgaagaataaaaatgatttgagtttaaagtgttaaaggactctagcttctaattaaacatcattttgtgagaaagaattcaggcacataatgggcaagtacttagaagatatttcgattttccagaaatacttttacatacacatatttcagaaaggcttgtaatcaataaatcctgggccatacatattatggaactcctagggctatctgtgcagattactcagaaatagaaaataaatcacatctttcccaataaaaggagttgctcaattcacaggatgattaaataatacattttagagtaagatgagatcttaggatcactgcttctaattaaagtcatgtgtgaattttcacttaagttttcacaagcatcttttattttatttatttatttatttatttatttatttatttattttttgagactgggcctcactctgtcactaggctggagtgcagtggcatgaccttggctcactgcagcctcgatctcctggactcaagtgatcctcccacctcagcttcctaagtagctgggactacaggcatgtgccaccacaactggctaattttttctttttgtattttttgttgagatggggtttcacgatgttgcccaggctggtcttgaaatcctgggctcaagcaatcctccctcctcggtctcccaaagtgctggaattacaggcgtgacccaccgcacccagccacaagtatccttatttactatttttggtaaactgaatagccacatcacattctgttttctggtgttgaaacatgaatattttgaaacaaactccctccctccctccatccattcgtccatcatattctggatacaagacaaacatcaaaagtctctcctcttagtctttgtggaagaagacatttctgcggagcatataaatttgaatggcaatatactcccttaagagggacttcagacactatgctgttctttctagcagagctgttggcttcagaatctaaacaaaactcctgagttgccaaaaacagccttgcattcttctttcagatcacctcaaggctctaagaggatggaaggagtgttttttgtttgtttgtttgtgtttttgtttttttgtttttttgagatggagtcttactctgtcgcccaggctggagtgcagtggcgcgatctcggctcactgcaacctccacctcctgggttcaaacgattctcctgcctcagcctcccaagtagctgggactacaggtgctcaccaccatgcctggctaattttttatttttagtagagatggggtttcaccatgttggccaggctggtcttaaactcctgatcctcatgtggtccacctcccaaagtgcagggattacaggcatgagccaccgcacccagccagaaggagtggttttgatacctgagcttccaacatggagagtccatgatttcatggattcactgtatggcaaaataagctcctgacatcacacccacaaaaaggccagcatcctactctgcagacaacccaacagcccagcattctgcctagtcagttatgtgcagttacatgtggacacagttatgtgcctccacatccatttttatgtgtccactgtcagtgaagaatagatcacagaagatccactgcaaggggaaatctataaagatttgggtttcctgcagctgaaataacaataataaaagggatgagctccttggcatttaaacaaagccctcagtcagaacgtgaacaaaaggaaagaggctgccaagcaggccctgcccgtgcagtccataaaagaaaatcttgtggaccctagagtttacaaaggcaagaaacctgttcttctcattgatgactgggcccagaacttaaacactggccacatgtccatgaagaaaaaagaaagagccttctcttgagacaggtttgaattcagaggcagagacgttccctgagcatgccctctgtgccaggcaccactggccttgtccacgcttgagccagtgttttgggcagtggggtgtgtgcatatgctctgggggcagggtcaggctgactgggtccttgagataatctctttccaccagtggccgtgggacatctcggtctgtctttgggtctgtctgcttatgaaaggtggccctttgtccttatgcaggtgaagatgaggctgcagaccagcctgtgacacccattcaggtgggtgttggcttttagccccccacttcactttacctggatttcttggttttacgatatagtcttcaggggtgggggtatgaggtcatagctgttgtctgctttcagcaaagaaggtgtttccctctccatttctgactcttgttcattctggaggcttcagagaaggaagttctgaaaacaggcactctctctgccatctttctggaaaccccttcagctgcttcaaaatatttagggaacacctgctattcctccctcccttcactcttacagcagatcttcactgtgagtgtagtgggtgacaggcagggaactaagctctttctctgagctcccatgacagctctgggagggaccagggaggagaggttaagcaacctgcccagagccacagacatgagcagttacactggacttcagcccaggacttggactcctggttcaggttctcttcccctgggttactccccgagtcaacaggagggccgtgggagaaaagaggtcctggcttcagctgggcagcctagggtgctggtcgcctgccaacctgggtgcagagcctgatctggggctctcccagaggctctccttggctggcaagcaggaagctccaaatgctgggctgcagcccagagggaaaggaaaggggcttctctatgcttctgattgtccccgtgactacccaggaacaaagcggggactcacactgcctcctgccaccagcctccacccagctgttccggccacgcagccccatctcttcagcctgtctgcaggaacactgggcatttgtcagctttcagaatcacggctgtgtgcccagggctctcttgaccctccagctccaggcctcatggggcagaccaacagaggcacaggccctctttcaaacccccaaacccaccacccagtgaagccaagtccctggtccacggtatttaactattatatagcctaacaccccactggggaggttcacaccctgatctgattaagctaaaactgcatataacagttcacatgcattcgctttccgtgtgtgcagaggaaagagctttgggttaaaagtcaaggcagttcatcggttagacctcaccaagcctgtcatcatctctcaaatgggaacagtagctgccaattctaaaagcaaacatctgctgggggcttcttagtatcaggcgctttcctacatcccacgtgtgtcatgcatttaatccgcacagtagtccacccagctccttgccctctgggaagagcgcagatgttgctaatggaatcttggtaaaaggtatcatgtggccccagaatagtggtatgcatcagattaccgcgtgcttcacgcatggtgtggtggagcttgcaacgtcacactttcaacaaatctattcaatcggcgggggttcttggcagcaactatgtgccagtcactgtgcacaaccaaccaaatccctgtcctcctgggggtgttgttctggtaaacacagcaaaggctcaaagacagcagatgatgccattagttgcacgcacttcattgaccgaaaagttgattttctccttatcttcggtaatgaacgaaggaagaggggacaagcagagggggtgcttgtcatttcctggcgtttgagtggatggcatctgctctgccccagcagtacaaggtacctcctgagtggccccatttgacaaggcaagagagtagaacttgcttttctcttgtagtagtgcagaaactcagtgtcccagtgtagttcaggtggctctccaggccctggtggtagggttcctgacactcaccatgagcctgcccggcttggcatatcacagtcctctggctaccacgggtccctgataagagcacctgaaatgacattgaatacctgggagtgcagctgggactcactggtccccaggtacaggctcagccttgccccaggctcagggatccaatcttgttgctggagggcggggcaggtcagcctgacagttgatcccgttctgacatagttttaggggctgagctctcgcttcattcatttattccctctgtaaataatgtttattgggcaggactatgagccaggtactgtcctggtggctgagaaaatcccagggagtaaaacaggccaatctctgtcctcctgggagcttatgtgctagaggggaggtgaattaatatgtatcatctggcagtaagtggtaagaagaaaatacaacagggtaaggagatggagcatgatgaggggtctatgttacatcgggtggtacggaagatctctggaagaaggagatatctgggcagagataggaagggtgagagggagaaagccaggcatgtatctgagggaagagcatcacaggtggaggaaacagcatatgcatatggcctggaggcaggaacgctgagagaccagtgtggctgaagggcctactccatacctcataccttcatgccagcagctgggcccatcagttcctcctgcatctttgggcctgggcctcagcttgctgcttcctgccctccaacccaagatggtgcccacctgcctggatcacttgccttcctcccaccccctcctgctgtcccccaaccaggtgcatctctctgttctccacctctgcacgctctccttgcaccaatgagaggtgtctgcagtggagtggttaaagtgctgggctttggagtcaggctgcctgggtggatcccaactctgccattccctacttggggaagcctgggtaaactgctcttggtgactcagttttctcaactggaaatgaggatatgatagtgcctatcacaggggctattgtgagattaaatgagttacatgtgcaaagcacatatggaatagtactcagcaaatattcatgaaaaaatattaaggtgacagaagccccttctttttcttttcttttcttttgagacggagtctccctctgttgcccagcaggcgggagtgcagtggcacgatttttgctcattgcaacctccacctccagggttcaagcgattctcctacttcggcctcccgaatagctgggattacaagcataaaccattatgcctggctaatttttgtattttttagtagagatagggttttgccatattggccaggctggtctcaacctcctgacctcaaatgacctgtccaccttggcctcccaaagtgctgggattaaaggcgtgtgccaccgtacctggccagaagcccctccttaccaggaagggtgaccagaattgggtgcttgctgcatggggagaaagtggaaagggcacaggctttggggtcagacagatgccgatgtgcaccccagctgtgtgttcttgggcaactaacttagtctctctaaacctcatttccctcacttccacaaggagatcatgatctgtcccccacagggtttgaaaaagggtaaattaaatgacaatgacaaatcacggagagattggcccaggacaggcagcttcactgatgggaagaaccaaccttgctagggacgaggttgcagatcaatgatcagggaggagagaaccaaagtggagagacaaaaagactggggagcagacgctcagggtctcaaagtgggggccaaggtgggccacagccagttcatgttgtgcagaggcccaccgcagtgaggggagagctgggccagtcgtgggatttgtggggcgtgggggtggggccttggccactctgccaaggctgggggcaggggtgtcaagtgccaaagggagcaccaggtgctgaaagccagtgccaaggggtagtgaagaaaagagagtcaggacacccatggccaaatccagacaagtcagacctgagccaggtgagtgctgagccagagcagggcagggcaaggattgttctgaggctgagttggttgtgctggtttattctggggatgctccttgcctgtcttaaagtggccatggtcagggcccacctcctaaacctgcagattggagcaggccccttgacatccctgcaggaggctctggggaaaggataaggcaggaccttcctgccccacagaggtcaaaccagtgaatagacacaaatgcaggaccgaactggaggtgccagctgacccaagggaggcaaagctgcttctgtctggggctcgggagtctgaacagcccagatcagcaaccaggtcaaatctcacaaacatgcacctaggggcttctggtgagcaaggaggaaggctatgctaagccaggcatggaaggtagtgcaggcctgattcctgagacaagaacaggaatgacctccccagaggccaccaagacaagcatttgagaaagaaaagaatgctactgacttagctccactgacatttgaatgaagagcaggagtaacaaaaacagagaattttaattacaagttcttgttcccccattgttcgtgattttgttaacgtctctagatctcccagtggtaattggcaataaaatctcttaaaacaaacagggttgtgcagtaagtggagaaatttcatttggttttatagctggctgaccagaggaatgagaaggccgtgtgcatttgggtggattgagcacctctttgagcttgtcttcccttttgagtaaaatccatgcttggaccagaccatgcctgaaggggtccctatcttaccagtgtacacaaccaggtggggaaagttatcattgtgacaatgtacaatgctgtccatgttagaagcctcagagtcactcccagctcctccctcctgctcattccacactaaaccctaaatgccatttcttaatgatctccttacccagctccataattgctgctgaaatgaaataagtccatcacatccaaatggctcctgggtcctgtctattctacttcctaaagggctcttgaaatggctgcctcttttctagccaactgccatagttcagacgctctttctcactagactgaggcaacaatctccctctggccttctagctggagtctttctcacttgaagaccatcttccatatggccacagaaggagctcttctgccttctaaaggctcctgaaaaccctaccatggtttcccagggtcaatgggatagagaaaggtgttctggctcttaatgatgggccccatatccactgctcctcaatacgcctccttgactgtagccaggcctagctacttgcaggcttggaagaaaccaagattttcttgcctctgagcatttgcacatgttatttcttttgctgccatgtccttctgtcacttgtcgctcttcaagtctcagctctcctgtcacctcctgctgttctaaggtgtctctcctctgctcccaggtgatctctatgcattataaggagtcagccttccacccataccagaaacccctcaaaagcaaagaatgttctaggcactgggaaatgcccaggatggagaagagtgtgacacaatagtcaaaaggcaagaacaacccaggcgtccaacctttgatggatgaatcgttcaaccaaatgtggcatggatatatgcacactccagatagcactcaaccttgaaaaggaaggaacttctgacatgtgctacaacatgtgtgaatcttgaagatattatgttaagagaaatacgccagtcacaaaagaaggacaaatactgtataactccacttatgtgaggtacctagagtagtcaaattcatagagacagagagcagaatggtgattgccaggggctgtgggcagaagggaaagggaatcactgtttcatgggtacagggtttcagtttggagaggcaaaataagttctggagctggagggtggtgatggtcacataatgatgtgaatatgccactgtaatgtatgcttaaaaatggctaaatggggccgggcatggtggcttacacctgtaatcccagcactttcggaagccaaggcgggtggatcacgaggtcaggagttcaagacaagcctggccaacatggtgaaaccctgtctctactaaaaatacaaaaattagctgggcgtggtggtgggcacctgtaatcccagctattcgggaggctgaggcaggagaatcacttgaaccggggaggtggagattgcagtgagctgagaccaagccattgcactccagcctgggcaacagagcaagactccatctcaaaaaaaaaaaaaaaaggctaaatagtaacattttaatgcataccacaattttacaaaaagaaaagtgactacagaggagtttaagaccacaatataatgaatgaatgaaggaggagttaagcaaggaaaatcttaggagatgatgtgaccaggtcagaacggaggagcctggaggctggggtgggggccacaacacctcactccccccacactccctgtcaatgtcactccttttcagatcagcagcggggcttcagggtgccagggctgtggttttcaaacctggaaaccaaaccaggttccagggctcctgggttcctcccaaaacaaaaggaatctttggggatgcagctgactctggtgggtgtttgtcctcagggcccctgctaagttctcctgggaaccgagtacagagtcaccaatgggacagaatcacaggagaaaaggagaaacatggtaagcccttggcagaagctggcacggactagattgttgtcgggtgtgggtgttggggccaggaggagcagtgagaagccacaggaggaaggctggcagagaggattcattccgtattcattcccctagtgagccacacgcttcggaaggatcacattaaagagatgaatcacacactgactcaaagagagggggtggcacggttgtaaatcagaggaatggcttttatttgtcagaatgctacaataaataacctctccgtgtgccacttaacaaaaggagagtgggagggagggaagcaatgtggcataggccggagggctcgcagggtgatgggagggatgcgggcaacctcacagctaccagggcccttcaggacactcttgccagtcactagatactctgtgctccttcacacacacacagagacacacacactcgcatagatcatctttccctcaaactttctgagagcaccagctttattttatacatacaggagatgtcttgctggagatgacattcgtgggtattactttttcagaatgaaggggccagaaaatcacccagggcccctcgagggctgaaccccgctcagaaagggagaaaggtaaggctgctccctagaatcaatgaagttgctgttctggcaatggtctgttaggacaagtggtcatgcagcaaaatcatggaaggaaactcttccaaaaagggtgcagcagggtggcggtattatctattgtccattttcttggggtggatttagaatcagacttcttgggtcgccaggagtaaaagtaaaacgctttaaaagtaaaaagctgcctggctctgcagggagtaggtagggaagaaggatgggaattctgggtttgcagaggggcagacaggcacatgacaatcaggcaggagggaggcagctgtgcttccagggagagcagggttcctgggggaagcccagggtcccacctcccctgccctagagcagggctacaggatatggaagccactagccacttgtggctattgaaatgtggctaggccatattgtaaggtttaagcacatactttatttttaacatgtagtatgaaaaaataaagaatgtaaaatctgttattaatttttttaatattggctacatgttgaaataaccttttggatatgttgtgttaaagaaaataagctattaaaattagtttcaactgtttctctttgcttttttaaatgtggctaccagaacatttaaaatcacacgtgtggttcacatttgtggcttgcattatatttctactggacagcattgctccagaggagtcctgggacccagaacagggagagcaattgctcttgacttgctgcttttatacctaggtgagtggggagcttacacttatgcactcagggatattttgggatacaggagcaacaccccaaactgtgaggggctggggcaggcaagctggttacacaccccatgggacggaggctggagagtttccatgacttactcaagtaaattaaggagaagagcttggcctagaatcaagccttgtaaattctattgtagtcttcttacaaccacatctccgtttacatagaaaaatgctcttttgtaattattagccacaaaacaggtttctggtgagaatgtaagtttttacatttttttttctggcagataatttacaaatttttatcaaaaccatataacctaaataaaactggacctaaatgcctgtctccacatggagatacacccaaaagaaacacaaatccagttccccaaagttttgaaaaatactgttaattgttgactgagatcccccaagagggcagcaaagggaaactgtcctgcacaagtcacggaaaatcttctaaaaggtctttagacatagttctctcttttacagaagctgctcaaatcactctctttcccctcctcaaacctgccctgacttccttctttagttccctctctcctctctggccaagctcttctgagcccctcttctctctgggatctgttctcttttctcttatttccatacctccaaggcccttctgtatgagaaaagttgttttcagttttcctctctgcccatcatctgatcagtcccaagaaatcctaaaaccaactgagtaggcagagaatggggagggttgcatcggaattttacatacttcgagcaaataaatccacttacagggatttaggatggatcaaaggagcaacagaccaaaaatttacatacaaagatacttatcatagtattatttaacataacgaaaaaactagaaatgacctcaacatttgacaaggaatagtggttaaataaattctgacaactctataaaatggaatattgagaagtcactaaaatgtctggctttgaaaatatttattggtgtgagaaattatccatgataatattaaatgagacgaaaccaagaatataaagctgtatacaaattttgatgctaatttcctctcaatttatatatgaacatagaaaaattcttctctgggctgggtgcactagctcacgcctgtaatcccagcactttgggagaccaaggtgggtggatcacctgaggtcaggagttcaagaccagcctggccaacacggtgaaatcccatctctactaaaaatacaaaattagctgggcatggtggcaggtgcctgtaatcccagttactcaggaggctgaggaagaagaatcgcttcaacccgggaggcagggaggttgcagcgagccaagaccgtgccattgcactccagcctgggcaacaagagtgaaactctgtctcaaaaaaaaaattaggttactaaaccccacctcataagggtgttgggagatgtagtgagggaaaaaaagacagcatgcgagaggtggcactgcatgcagagtcacagccggctgcctgggcatggatcctggctcagcttacactgtggtcctaggcaggtcacctggccccacattgcctcaatgttctcatctaaaaaatgggaacattaatgatacttgcatccaccctaatacaggcttgttgacgatgacaggagtcaacagaggtgaagcatgtgaaaaatgcctggcacacaccaggcactcagtagagatgagtttcttgtcttgtgatctttctagagggcctttcttaccctatcctctgctcagggcctgccccacttctcagcctagccctgaggctgctcatctcttcctcatcacttctgattttacagtccattactggttggctgccattactctagactaagagtctgcaaactacagcccacaagccaaatctgagatgctgcctgtttctgtaaataaagttttatggcaacgcagatacacccattcatttatgtactgtccctggctgcttcagccctacagcggctgcattaagtagttgtgagactgtatagccagcaaagcctgaaatatttactactacctggtctcttaccaggaaagcttgccgacccctgttctaggccaacactgtccaaaaaatgtataatataagctacacatgtaattttctttctttttttttttttttgagatggggtctcactctgttgcacaagctggagtacagtggcaggatctcggttcactgcaacctcctcctcccaggtccaagcgattcttgtgcctcagactccccggtagctaggattacaggtgcgcaccaccacgtccagctaatttttgtatttttagtagacacggagtttcaccatattggccaggatggtctcaaactcctgacctcaagtgatccgcccacctcagccttccaaagtgctgggatgacaggggtgagctaccacacccggcctacatatgtaatttcctagtagcaacattaaaaaaggaaaaagatacaggtgaaaataatttttatatttcctttaactcaatattccaaaatgctatcattttattgagtaataaccataaaaaactatgaatgaggtaccaaaataatgcccgtgtctgatgcatgcactacgccgcaacagtatctgacaggatgcaaaggtgaaagtgaactgcagtacttcccaaacagtgcaactgtctgtaatggaaacatattcctcactgctttagcttttaaatgtaaatgtaaatgaaaactaaaagttcagttcctcagttgtaccagttacatttccagtgactaccatactggacaatgccgatctgggcataccccctccctacgtatacttacgccccttccatgcacacagcagatgagttttcacatggcttcattgacatgcaaagtgattttctcttttccttttctttctttcttttttttttttttttttaatgggattttgctctgttgcccaggctggagtgcagtggcatgatcatagctcactgcagcctcaaactcctgagctccagcgatcctcccaaatcgctgggactacaggtgtgcagcaccatgcccagctaattaaaaaaatttttttttttttttgtagagaaaaaatagagaaaactatgttgcctaggctggtctcagacttctgggctcaagcgatcctcttgcctcaacctactaagatgctacaattacaggcgtaagcctctgcccccagcctacaaggtaattttcaagggggagggaattttaggtgaggaatgggggcagagatagtgaaagaaatatgtggggaggggggtgtggatgtccccaggttcccctggtgggttctgagcccctggggagagagaagtcagagacagaagccaagggaactcctcaaagggatttaatgtgactttgggctcaagcaaagctgctctggggctcaggtgacccggtgccaccctctgtctacccagcctcccacctctgtccagagtcagaactgccctgggcctgaggactggaggcttcagactatccagacaacccaccgcaaggagtggccaccccccgacagtgaggacaggagcgcagcgtctcccagcagcttccagggcagcaatgtgcctcagtgtgaggcagtgcaggaacgcaggaggggagcagacacccatggtccctgcggctaatggtcctgtttgtgggcatctgtaagaccgcttagaggactcctcagaatcactaggagccagtctgggctgcatccagatgagcataggctcagagaggcgaagtggccacccaagaccactcagccaatgacccctagtagaaggtcagcagccaggagccccagggaaggaaggagagagaggcctgagcaggagagagagctcaggctattctccctcccagccgggatcaaagcaccctggagtctgctctctgatgcactctgggacccgggcaagcccatttgctacagagcagcacaggttaggcacaggcatcctgctagcagtcctgggacatggtccaggtaatcagtgccctggcctgtggatttctccatattgtatctcatccaggagagcaaaatttgaagaaagctgggaatggtaaatccttctgctaggaatgaatgcttaatggaataaggaaaactccaaataagtgcccaggaacatccccgtggaaaggaggggtcatgtcagccagctccaagaccttctcaactcattcctccttctcaacttgcttggtagctgagcccagctttcttccctctgaggccaaatcctacatcctctgccacccctgtatcctttctatctgtggttcttcccagctccatggaacgtgagagcgaaagcctgcagccatctcgccccctggctcctcgtccctctaggtacccagtgagtcaggacaaccctgtgctctcctcacctgctcctcacagcagctgcaggcaccctccttggacaccgctgtcttccctggaccaaggtcatggctggtctgttcatctcacagctcatatgaccacacctgcagcagcggaggtaggtgtagaattgtggcacctcagatggagccaaagtggggagcacttacctaaaacaagactgttttaggtggatgtagccatatgattgtgggcatgttatgtaaccacttcatgcttcagtttcctcatctgtaaaatggggataataaagcatctgcctcacaaagtgactgaggaggggaaatgagttcatatgcgtacaaggcatgagttcaacgtttgtgagctaccattgtcatgaaaaccaattttagcattttatttgcagctgtgagtttattttacacttgatcttagccagaatgctaagaagtgatggttatgagtttattttaatatgacctacagaaaatttaaaatgacctacggaaaattacaatcaagctcataatttggcagaccttattgtttaggtcaaagctaagtaaacaaatcaatgtaaacatatttaaagaacataaataaatactagtgtaggtgataggctagtgtgtcatgaattgccaagatggggcacacagactatttgggagctattgatctagtctgagccctctagttctataaggaggaaactctaaacaggaagtagtgagctgagaccttggtcaacaatgtagtcaccggctgggttgggaccagacagttgccccatgccctgtcctccctgtcctgtcattctgccccctcaacagactcatcaaggtcacatttaaataagtacacacaaaagcagcttatgcatagacagcttgtcatcagacaggatcacacgtaacacccaggtcaaatcctctgccatgtcaaacaagataatcccatggagtaaaagcaactcctttacaaaacagggtcaggtgctactttctgactccagggtcagagaggctggtggaactggcttctctggctctgccacttcttaactgcgtgctatgatttggatgttcattcccccaaatctcatgctgaaattggatcccagtggtggaggtaaggcctagtgggaggtgtttggatcatggggtggatccctcatgaatggcttggtaacctatccctcaagagctggttgtcaaaaggagcttggcacctcccctctctctcttgctccctctcacaccatgggatctctgaacatgccagctcctctttgccctctaccatgagtggaagcagcctgaagccctcaccagtagccagtgctagtaccatgtttcttgtatagcctgcagaaccatgagccaaataaaccgcttttctgtataaattacccagcctcgcatattactttatagcaatacaaacagattaacacaccatgtaaccttggaaatgttgcttaatctctctgtgcttctgttttcagatgtacaaactgagataagaggtggtaaatctagtgcacagaatgtgaggattaaatgtgagtttcctttcttcttcctctaagagcaagagcaagtacctcccgccaaagatatgggagaatccttacgtaggaagctctttatctatctgtgagttcacccatcactctctgactacaaaaccttcagccactccctgtttcttaccactgcaaatctgcaggcctcaacaatgtggccccttcccatcaagccaactttatctccttggtccctaacacttgtcctagcatatcccatgctccctcatggccccatggacaagatgcatccatactgactcccaacccctgtaccattttcttccccacattggtgtatagactgatcttgcaaaaacccacatctaattaaccttcctcctgaaagcctctgcacaattcaccctttcctgtggaataaagtccaaactccctaccactgcagtcacagtctctcatcatctaaccccattccctctcctgtagtcatccttagttatccataattctctccccacagcacaggcacacatgtgtacacacacacacacacacacacacacacacacacacacacacacgagtctacactcaagccagtcaggtccgctcactgttccttcaatagcttgggctcctttgcacctgcatatttgtgcactagctgctttttatccctggaacactgcattcctttctttgctgggtaaatgccttctaaccccttagcactttgctgaaacagagcattttgttttgcaaactcccacctccactcatcccttgcagcttaggtgactaagtcctggccaataagatgtaagtgaaaatcactgggtggaactaccaagaaggctcattgaaaggagcacagatggctgcatggcctttccacctttttctagtttttttatatataatggatgtgatggctggtgctccagcagccatcttagacacaaggtcaccttcagaatgaaaatcatgctctatggatggagaggccaaagagagaagttgcctgggaatgctgatattgtggtgctaccatataccaaggctagactggctccctttggttcttttatgagagaggaagataaactcttatgtgtttaagccactgttattttagtttgttgttatatgcagaaaatcgaatcctagccaatataacagacatacaagtcatttcctgatttggctcctacacacctctctagccacacatttcccctccccacccccaaaccccatactccacacctactaatctaatttcagtttcctcaatgcatcatgcttttctcaggcatcacacccttccccctctcctccatatccctcctcagaccacctgggaacacctgctcagccttccagacccagctcaaggaacacctcctccgtgaagcctttccagatgcactctctatacttctcccaggcagaagtgaccattcctcccactccgtatgcccccaaatatctaccatgaaccctctaacatgtcatcatttagtcatccacctgtacctccgaggtcctgagttgcttgaggcaagagctatttcaatcatctttgtctccagcatgtagcccaggacctgggaacactgagcacaagtaaagttgttcagggaaagttcccctgaggcaaggtttcatctgggattctggcccaaggggcagggctatgtccttgggagaggatgggggctcctgcagggcaaaagggcttgctcttgagcatattctgccctaggaggcaccaggaaatgtctgttgggtgggtaaatgaatgtgcaactcaacctcccttcaagcttctctctctaggatgctgacttcctccagccgtggtggtgctgcctgtcaccatctgaccctctctgcttcccttcccctgccatacttagcaggcactcacagctggaggcaggaggctctcaaagtgaagggaaaaactcttagctgccaccatcctgaaacctgccctccccacagccacaaaaggccaaggagcatggaaacagctgctgcaaggagaccagtgagcaggaaggtggggcagcctcacaggagctgccctgactggggccttccctctagcagtgaccttgacttagagaaaggacaccttccatggccactcaaacatacacatgacagtttccctccaccttcattgcatacactgaagacaactggacagaaaataaagaaagtaaggagaacttccagaaccatagccagaaatgcagagtaacttaaagtagctctgttttaatatattgcttgcttcccccaaggccctgcagggatggaagctgtatccttcaagggcaatgggatgaatagtggggagaggagaatgttcaggggatcctggattctgctctttccaatgtgaatggccaccatatggaagaacgattgggccactctcccagaaagctaatgatcagtgtagcatcagcccacacaggagtggcctgtcatgggaggctcatacactgtgtgccatgaagcagtggacatactcagaatcacatgccaccacaaagacttcgggttctgggaacttgggacctcctgccttctggggcttcttggaacatccatgcagtctggccccaagaatgccaattgctcctgatacctgagccaactttctgggctccccctgtctcatcagggatgctctctatctgcagagcactacaagtggctcaagcctggttctctgactgcttcaaaggtccttctcttaatctggtttacctcactcttctgcctgcttcttggagctcagcttcctatgactggtgccacaaaagttcctagggtcacacacagaggggcagagaagctgatccactggagaggctattagaacaggtgggaggaggctgcactgtgaaccagggtctggggccatgcctttcccaccacatcataagcattaattcattaattcattcacaaaatatatatttaatgtctactacatgctaggcataattctgggaataaagcaatagaaaaaaaacatgtgatgaaatatattcagggaaatatattttggtttaccaaagtagaaagatttctgtcctgcaggaaggactcagaatttttactatgtcagccacaggtactgtgacttgcccagaagggtcttagcatataggccctttgaggaagaaacatcagtgtagaaaatttgaaaaacgtagaaatgcacaaagaagaaaataaaaattactggtaatccaaccactcagaaaatactcttataaacattttttgtgtttgtcactgaaatatttttatatacacatctataactgcatagatgtacccaccataacttacaaaaccaattcccacattcttgtgtatttagattgtctccagtctcttaatattgcaaacaatacagtgaagagcatccttgtaagtaatcctgtattagtcagttctcatgctgctaataaagacatacccgagactgggtaatttataaaggaaagagttttaatggacttagttccacatggctggggatgcctcacaatcatggtggaagacgtaggaagagcaatgggacggcttacatggtagcaggcaagagagtttgtgcaggggaactcccatctataaaaccaccagatttcgagagacttattcactatcacaatgacagtaggggggaaaatgcccccatgattcaattatctccacctggccccacccttgacacgtgggaattattaaaattcaaggtgagtttgagtgggaacacagagccaaaccatagtagatccttatccatatcagtgattattttactagtataaatccttgaaaggggaacttataggtaaaaatgtagaactatttgcttttatactgccaaaatgccctttggatatttgaagcaatttatgctcttaacagtggttgtttaccatgcctgggtcctcacaccctaacaaacaaacaaacaaacaaaaaacaaaaaaaccctaagtatttggtttttatttttaaaaactgccattttgataggtaaaaatggttatctcattattgtaacttgcctttcttattactaggcaaactaaacttttcccatgtttattaggctttttgaatttctttctctattttatatttattttgtccattgctggggaagaatttttttaacttttaattttgcaataatcttagaattacaggaaaattgcaaagatagtgcagagtttccatatacccttcaaacaatttcatctaatgttaacattctccataaccatggcacagttctcaaaactagaaatttatttatttatttagagacagggtcttgctctgttgcccaggctggaatgtagtggcacaatcatagcttactataacctcaaatggacctaagactatatagtcatgtgctaccacgcccaggtaaactaagaaattaacactggtacaatacaatgaactaaactctagactttatttggatttcaccaatgttttcttgactgtcctttttgtcttccagtatctaatccaggatctgacattgcatttagatgtcacatctccttaactgtcctctggtcagtgatggattttagcctttccttttcatgatcatgatatttttgaagagtcctggtacagtattttgtatgatgtccctcaatttggatttgtcttatgttttctcgtgattaaacaggggctgtgggtttttggaggaatgtcacagaagtgaaatgcccttttctccatttctgaggtcacgtgataccaacaaggtgcattactggtgatgttaaccttgaccacttggttaaggtgatgtccgccaggtttattaactgtgaagttactattttttccttgccatactctattatttggaagtgagtcactaagtctagcccacactccagcggagggaatttaagctccatctgctggaaggggagtagtatatatctagaattctcctgtaaacaagatttgcactttcttcccttatttatttatttattcaattatttatttacaacaaatgtggtcagattctttgggttatagttcaatactatcattatttatttcggtgctcaaattgttctagttttggctgttgagagctctttctggttggctcctgggtccttcagacatcctaccatctttttttgtcttgctttgttttttgtttttaaacacttccttactttctggaactacaaaatgttttaggctcatttttttgtgtgtttgctttttgtttttccctgcccaggcctggaatcagtcatttctccaaggagttctggttctttttactagagaatggtctttagagactaagatctgggcagtgagtgtgcccatttctactagggtattattggttctaggctctttcagcggacagaactggaaaatatatgtgtgtatactaatccatgcatatctctacttctgtatacttctatctgtacgtatattaaaaatacatgatatttttgactctaatccagcactatagagttcattcgagcctttctagggcaaaaatgttaaacctctaaagcacctctgaatactgtctggaatctccatttcccacccaattctgagcaaaaattaaatcaagtagagcattgattggctatgactgatcccacggccatctgccgggaccacacgacagccccaggatggctccagctctgttcctctgggcctggagaaagcaacagaggacagagaactatatgaggacaaagaataaggcagccttgcccagagttcaaatcccagccctgccactaactacctcctggtcgattctttttccgtaaaatgaggggttaaattagatgctgcatagatctggtattctgtgattacagaaggcactcgattcatgttggctgagtgaatgagtgggtaaggagaggagtttggcacatgccagggcccctctctagttcaaatccacggtccatcattatcttgagcaggtaatttaccttgccaggcatcagcattttttattttattcttggtacttctctgtattttctagattttctacaataaacatgttattttatacttactaaaagaaaacaattagattttttaaaaaaacacaatagcatataccatccttctccctagaattattatcagtaagtacttcacaggctggcactgaggagcactgtgctcgtgtggatgaacttgaacccatgcaagcttcaagttcctgccataaagtaggtgttcaacaggcactagtttctgtcctttcttttctctctcctgctgatccagaagctacattgtgaaactggtggaaaaagtcttcctctcccttttttccctagtgtgagtgtgatggccatggcaaaaaaagtccctgtcaaatgagcccctttctttctcactcagagttctccctccctggcatcctccgtgaagggcctcctcaaggtgtctttgcagaaatgtggagtgtccaccatcaaggaagatggagggtccattcccaggtcccacacctggctgaacacgtctcccagtccagcatgaagctaaggagcttatgctccaggaagctcctgctcattttcaaccagggcccagctatggttgctcccctgagccctcattatctgtgctgaagaccttaggttgcagggtttgaagcctcacagagagcagagcacagtatgtgagcttcaggctacaagcctccaccccagcagtcctggcttaaattctgtttctctgcctaagatgaattcctccaggaaactattcccttccctccttctgagaggagggaggaaagacggcttttaaattacatgcttcttcttatttaaaaaaaaatgatggagaatttctggtaggaggaggggaaatattttgtacttctagaaccaagaaggcacagacgttccaccacgacagcaaaagtcccaagtccggaaaagctagcatattcagcaaaagcaaagggaactgagggcttctcatgaaaacaaatctagaaatacttgaatttgttttaaaaaattaggtcaggcacggtggctcatgcctgtaattccagcactttgggaggccaaggcaggcggatcataaggtcaggagatcaagaccatcctggccaacatggtgaaaccccgtctctactaaaatataaaaaattagccaggcatggtgcctgtagtcccagctactctggaggctaaggcaggggaatcacttgaactcaggtggcagaggttgcagtgagccgagatcgcaccatggtactctagcctggcaacagagcaagactccatctaaaaaaaaacaaaaacgaaaacaaaaacaaaaaaccatcattctcagcaaactattacaggacaaaaaaccaaacactgcatgttctcactcataggtgggaattgaacaatgagaacacttggacacaggaaggggaacatcacataccggggcctgtcgtggggtgcggggagtggggagggatagcattaggagatatacctaatgtaaatgacgagttaatgggtgcagcacaccaacatggcacatgtatacatatgtaacaaacctgcacattgtgcacatgtaccctagaacttaaagtataattaaaaaaaaaaaaagagagaaacactcttttccaatagggattccaaaatccaaatcgtggtcccttgtcagcaccattgagttcctaaccatacctggagggaatattacaagtccctttgcactgatgccaagcctcaaatttgtctgctttctgtattcatactgaagtgaacataaagccataggctgatgccacaccaggctgtgctgtcagtgaaacccctgaagaagtataccaacaaagatacaacagaataataaaatcaagcttggtcttttctccaaaaataattttaaaacctctgggtagctggttctcttctgctgccttttttttctccccaattaaaaaatgtatttttgcacctacactcttaatgttttatttttattgtctttgctttgttaaataatctattgtgtgtttgcatttgttaaatcactttggtccattcaataaatgtttattgaagaaaaaaaatcagcattttgtcatagagctcactttccacatgagctaccttcctttctagtggatttacaacccagacccctgcttctgatggggctccttcaaaattattaaagtgcttgactcttgtaatatcatgtagggttgggttatgtctgccccaatgttgacatgaagaaattcctccctttctaaccccacggacagacagcacttagcatctctcacctggagcatcacttcagcctcttgacttgtctcctccctccttttctttactgcagaacttctcagaacctttaatatcctgatgatcttccaagagggaaatacaacacaaaataatatatgtatttcctcaacttatttagtcatgaaatcttttattcaaagaacatctgttaatgcctctcaggccactaggttctaggaactcagtttgggaaaccccaccctctaaaatataatcctaactcctcagtaggcatgtgagcccttccattgtctgctgtctgcctccctccccaggatcatttttcacctctctcttatacctctgacattcgccctagaactgtttgtggttccttaaacatgctgtcttatttcaaacttcagtgcctttgcatatgctattccaccagcctagaatgctgttccctgctgtcctctgagttcaacactgccaactctttgaaatgtccccagctccctcaggctgacaaagtcacaccagccccaatgttcctgcagtgctagctttatgcttatcagcacttccccagactataaatgtgtttctcgcctgtaaatcgtcttgcttcttgctctctcctggcctaattcttcagctcctatcaatcccattagattcccatctccctttaatacatttcctctttttttaaaaaaagttaccaagaatgagtttcttagttgcatgagatcaaaaaaatcctaaattctacactcagaaagaagagttttaaaacacttttagtccaaaaaatgcatgttaaaaatggcacccccccttccccccaaccccaagcatacaggtctcttttcatagggggaatcatgttcacagggccccagggaaaaatgcagcaggatctgcctggtgcctgagaagctgcacactatgctgactcagatccagagagacagcattactcaggccaatcagaaaggtggtacccacatccctaggagcagccttacccaactctactctgcaaatggcctcttcctgggctttggggcaggcagggacaagagcatcaattcctgaacttcctgaccatgccacgttcagaatgcttccttagaagccatttcacgaaggtttccaaaaggaggatttttatctttcaaagtaaatgaaagaggatatagtaaactattgctaaactgtcccaggccctttgcaatctgactttgcccctcctttcatcaggggtggagtctatttctccctcccctgaatctggctgggcttgatttttcctttggtccaaaggatgtggcagaagggatactgcaccagttctggcctctgccttaagaggcatggcaggcttgcttccgcattcctggagtcctgagcctgccatgccatggaggagctgggtctggcccactggaggacaagaggtcatgcagagaaccaggctgctccagccaagagctggcaccaggcccctcgatgtgagggaggctctcttggacctcccagctcagccccaccaccagctgaatgcagctgcaggagtgagcccagccaagaccagcagagaaccacccagccagaattgtgagaaataataaatcatgattttaagctacagagtttgagtgtagtctgttaagccagcaatagataatgaaacagaagggaaggctcagaagccagcagggaactcaaatgtgtccagtgatagaggatgtgggaagtccccttgctatagaaaatgcaagagcaaggcaggtgcccctttcactatatatgcaaagtaccaagggtatcagaaatgcaagtgatcagatgcctcccacatagagatgggctaggatatgcccttcctgcttctcccataatgttccagacagggcctattaccctgagacaaaggaaggaattcgttacctgcctacctaaactccctccctccctttcgtctacattatctggccctgaaccatgactgtgcagagaacaaactacaattaatgctatcttttacccacaaggagctacaattactaagtggagttaaataaagtcacaaaggacttaaaagcaggtacgatgaagggaggtcagaagacaggcagtgtaaccgtgggcttattagggcccagaaaagaagaagatgcaaggctttttgctgaaggaccctctgtgctgagcctggaaggaagagaggtccctgcaggaagagattaagtgaagatattattaaggttgagggagtagcaaagggatagcataagagcaacatccccctcccttgccccaggtaattcctcccttcaatctggtctcccttcttccctttccaaggttcctcaaggccatgccacctaggctgatgggttttcttatctctctactccctcctgcacccagccctaggttgagttaattgggaatactaatcatttgagaagagctactaagacctgagaatgccccccaggtagtagttccagccttggtaattttaagactcttacaagaaattactgatacttttagcatctgttgattgagaaaatacacatgtgaaaatagatatcagttctccttataataatgcccctagggaatcagctgggcatggcagcatgcgcctgtagtcccagctactcgggaggctgaggcaggagaatgtgtgaacccgggaggcggagcttgcagtgagccgagatctcgccactgcactccggcctggggcacagagtgagactccatctgaaaaaaataaaataagataaaaaaaaaatgcccctaggggtccaggagcaggttgaatccaccaaaaaccactgatgagaggaaataatcagccaatgaaacagacccatgcttttagaagggccttcgttgctttgaccccaaaagacaatgagggaattgcaggatctgaagctggtatgtcaaggagtggggggcaggggagaggcatacccttggcccacaggtcctactgggacaccactatccagctgctctgggagagaagcaaggtgtccaaatgtaaatgccatggcggctgggcctggcttgcctagccacaagttcaaactctgctcaatgctggactggtatcatgtccctgccagtttagaaagcatctaaggcagtttggaaaagcagtagactagaaaccactagttaagtaactttcagactcagctactacctagctttgggagtttttccaagctttttgtttttgtttttggagacagagtcttgctctgttgctcaggctggtgtgcagtggcgccatctcagctcactgcagtctcaacttcctgggctcaagagatcctcccgactcagcctcccgagtagttggggccacaggcatgtgtcaccacacctggctaactttttatttttcatagagatgggggtctcctgatattgcccaggctagtctcaaactcctgggctcaagcagtcctcctacctcagcctcctaaaatgctgggattactggcatgaaccattgcacctggccccaagcttttttctttttttggctttcatcttcaataaaaaggtgatggagggtgggaataggagaggaatgctgaacttgctctccaaggcattgccaaagtgccaacatcctgagcaaatgattctagtcgacttactgtttctgagcctcaggcttcttacctgtaaaatgggaatgacatgtaacaattaaatgagatacaagttgtgaaaatgacagtcacatagcaagtatcaattaacatgggtttttctctcttcctcccttctgtccttacaatgacagatggttctttcttcccagtcccatccccctgctcttactgagttgctaatttgacctctgagtataaaatgtgtccacttttagtgacatgaagctagtcctcccagagagaggcattgccaaagtgagtatgatgacttcaaacacgctcagaaaccctaggaagcagctggcagggtgcccccactccctgcccctggcaatgctgggttcctctttggcatttgtacagaagggaactggcccaaggcagaaggatgggcctaggctggtgaggccacctccctccaggcctggccaaagccaaggcaggcacagacagcaacaaccacccattttgcaacaaacaggaaaccagtttaccagcctcaaaaatagaacagacaaaaaccccaaaatatgaggctctgacagtggggcagctcagctttctcacatggcttcctgacaggctgcggagtatgtgttgttattgttgctttaaatttcacaggcgaaaaagtcttgcaatgtctttataaaggtgaccagcctctggggcccaagaccagcaggcagcccagccaatcatgcttcctgcactgccaaggccccaccttctcagtctctgatccagctactaatgaccccaactgcaagggccacagaagccttgattcctgtcatgtcctaacaggattggccctgacatgtctgcaaagtgagtcttccacaccccagcattgcttttcctgtggcccctcacctggtgccatgccactcaccccaaaactgcttccataggtacccagaggccccactgggccacatggtccaagagccacactgacaataggcctgcagacattccctccacgtgaagctggactcatgctgtcccctctgccaagaacagtgttccttgcctggtacactctcctcagaagcaatcatactggaatgacatggttagaacagcaatgttgctaaggactatgtcacacaaactccccttgttgagggatcacggggaaaatgtatcttaggtcttagccccagggaaagctgtgcacatcctgggcactgggtgcatttttaatcctctggacatgatgactaagaaccgcctatcgattatgttccctttttgtcttcattgttaggaagcacagtgccaaacctgttcatcacctctagcaggtttatgtcctaacctgtccatggctttattttagtttctcctcttattttcccttgcatattatttctttattaaatttattttaccttaatgtagaatgtatatgatctcaaatctttatttggaataaagtgaggtatacataaataactgagcaaacagctcctacttactctgtaaaacccacttcgaatgtccccacctccgatttctgcctaacgactccacaaaggtgggcttccctccccagtggtcccacagcccctgcctgtacctgcctggattcacactcacccacagttctgtattttactgttttcatggctctccccaccaaccgacagaaggttcctgtgtgaaagctaaaagcccgccctctgccaaaatctgcccagtgctgcaggcacacgggcttgtttaatcctcaagacaaacctgccagataaggctggctgtgcccattttacagctgaagcaactggagctagccaccaccaggtgctcattcaaggtcatgtactattgagtggcagaactgatacagaaggcttatctccctaaggtcacccaagacatgaaaaagagtttttatgtgaaagagagaaaaggagagagagggaagggatttagatttccttagattatcaaatcattcactgcagatgtcaaagtcatctgcatcactggaaccatttaaaatatggcttgattcataacaatttatcctctacgactatctagaaaaatctacatgtatttaattgtggcagactcatgctgaccctccaataggctggtcagagcaagtggattagaggagttactcacatgctagattgttttagagcatctcctatcctcactccctcacccactgtgtatacacacatttttaaatcctggtaagtagttacaggaaaaaaaatatatactcagaagacaagagctaattctgcaagaagcttctaggagaaaacaaagcctactttcccggtaggcaagtgcacatgacccatgaggccaatcattaccctggctttacagtgtacagacaattaaactacatgaaatggccgggcgcggtggctcacacctgtaatctcagcactttgggaggctgaggcgggcacatcgcctgaggtcagaagttcgagaccagcctggccaacatggggaaaccccatctctactgaaaatacaaaaattagccaagcttggtggtgcgtgcctataatcccagctactcgggagactgaggcaggagaattgcttgaacccaggaggcggaagttgccaggagccgagattatgccactgcattctagcctaggcaacagagtaagactccctctcaagacaaatttaaaaataaaaaatcaactacatgaaacaatttttaatattccaattgagaacccacttggcctgaggcctttaaatcaaagtggccactggtatctacacgtgcccttccatggaatgaggaaggcaggacaacagaggctgctagggtctgggttcaaatggccttgggcaagctgggggctctccctctgcccctcgtttacatgcgtgtgcgtgggagatgataatgacaccacctcttagggttgcagtgaggacgaagctggcacagggataatgttgaataaatcactgcatcccaggcaagaggatacgtgaccaagagctggagtcctctttgtagaccttgtgttcttccattttaaaatgagaacaagagccagagagaagggaataaggcataagctatgaatggacgggaaggagaaagatttctgacccacctcttcacaaaagcagcccttccatcctgatggagagcacctcttttgggggtctgatttgtgtctctcaggccaccttacgccttgtgttctgtgtgtgtgtgtacacgtgcacgcacacacatctcctctgtaaagctcatgcacccaggtcctgagcctgattccccccactccctcccgtgtctggtacgtggttgagatcagtaagcacaggttgagtaaatcacaatggtagaagcagtaccagctgaggcacagaagggatcttcaaatgtcagttctctttgtcctccttgccagatgaggcccccagagcctgccctctgccttccttcctgaatgttccagggactcccctctgctctccagacaaacaccctcactctgccaccaaggcccctctcagcctgcaccagcagccaccccccagggctgcccccttatcatcccctctcttcctgttgacagccttggatgacataaccttaggagacccagccacggatcaacctgactacacagcgtgggcatggtaggggaataggtgattcaaagatttcctgggtgtggtcccctgccctctcccttcaccccctctgaagcatgtcacagtggttgacagattgaaggcccagccccggcatggagcccctgctatgccacttacactcttctggaccttgggaagacaacttcacctccataagcctccatttcttatgtgtgaatgggggtaagaagagcatggatgcatttcacctgcctctgaaggttgtcactagaatgagaagcactgatctccacccggcacatggcgagggccagcgcaggtggctccgtcccagcaccatgatgagtaaaagctgagcaggaagggggaaactgtgcttcccctctgtggcactccagtgggcaaggaggccttggaaggcgcagggccggggccagcgggaccactcaggctcacctgggactccagagggaaggggcatctcaggacgactccacagggtagggggctcctagctcaacatcttccctgctttacccaagagaggtcaagacgacaggactgagagtatgatgtgctcgccaccccttgccctcaccccacgccccacccacacagcccctacaccttcaggaggatgggatgagtcatcattaggtcactgggtcatcgagtaagcagtgggggccacagggtgcagtttcctcccttcctccccgcccagcccacctacggctctcctcctactctctgcccccgctactttcctgtgctctgatgtgggagggatatcgctcattgacaggtttcaaaactaaaagtagagcgcatttagtcttctcctgtggctgagctcagctcccagctcccagaactttgccatgctgctgcagggccggcatgccccctcctcaccctcacggggagggcccccatggtgttagccagggctcaagaatgaagctaggacaggaggggcagaagacgatgaagggaagtgcaaacatatgaccctgtcatctgttaggccttgaggtagatcctgggaccccagacgacagaagagtggaagggaaatcagaaaccagcatacttcacctgtctggagtgccagaccctgccaggtacagagagagagacagagggagtgagggaaggagggacctgtatggagactgaattacagggcagacacaggatccctacagaatcctgccaggcagttgttccaatgtgtagcgataagcagtgacagggcagaaatgggaggcgattttcccagcctgtcacctccagcaaggtgtgagccagaatgcacacgcaggcctgcgtgtctctggggctgatgacagagtcacaaggaaacagatctccatagcacagcgtggaaagggccaatgctgttgggtgaaagatgctctgggaggtcaagagaagggccaattaaccccatctggggaagcatttcatgacggttgtgatgcttgccctggatctgaacagcacatgcatgggaataggtcaggaagtcaaggggacaaagatcagggcaaaggcaccaaggtgtgtagtcatgatggggggcagggggaaggcatcaggaggctccagccaaggaggaggctgtgaaggaggcactcagcagcccatgctgactttccttataacttggaccccagaagtcactgctatttccagaaaattagagtcacaaatctgataatattatcaaccactaacagggcatccactatgggctagacattgtcctaagcacttcataaacactacccccatttaatcttcacaacaaccctataaagtaagattactacccccatttggtagagatcaagaactaggcccaaagaggttgactcacttgcccaaggcacacacctctacaaggggtggggctggacttgaacctgaggctccagagggcatgctctcctgaccactcagctgggttgccccaaagaccacaaaatgcctttcctgctccccagaaggtccagttcatcctctccactaggctgcaggcatctccagagcagggctgtgtcctctcctccttctattgagttcccctacctgagcctggcctttgtaaagaaatttgacaggcacatcatgacaggcagaatccaggggaagaaagcacttgtcacagtccagtttgggctgggaaccaacaatttgttgacttaatcaggcagatgcaaaaaggtgttgtcatggtggcaagctttctattccaggcggccaggccataattaaatgtcctgacctgcacacctccaattacagcacaagagctggtttcccaggcctgttaactagcaattatagaaccttccagtgaaattccaaatcacttagtaaaggtcaacttcctttatttatttttcagatttgggggtagaagtgaaatggaattattgcccaaattatgtgtgacatccattacttaaaataggtttattcaaacggcccatatggagcaagggatggagcctgcagttcttacaagttgttataagggatctcatttatggagcacctgctatgtggcaggcaaaaccacagtggctttaaatgtgttctatgatttaattcttataataaacttaagaggtaggaattactatttccattttgaaaaggagtaaactgaagatcagaaaagttaagtaaccttcccagggtcatacagctgatgcttcagaattcaggatttacagccaggtctgtctgcctctggacaccaggctcttcccattactaggtggtctcaagctaagtaacacaatttggggttcagagcacagctcctatgtgttgtgcaaggagtgctgagacctaaaatattcccttctcctggcctatccatgaaggcacagttgaggcacaggtctcttccagcctctgggatggttaccatgttagggttaataacccttcattgttgacggctcagacagctttttatattgataagagagacttggaacagtgtgaggacagtaggccttcagaacagaaacaggtggtaccaaagacacggtcttcatgccatcacttgccacgtgatgcccatggcaggtgccactaatcaacagtgaccccaggctccttctcaatacaggtgattcttccaatgcattgaactggcccaggagatgcaaattgttttctctctctgtcttagatatatggtgaccatattttctgcatgcaaaattctgacatgtaattcaactgaagattatttccctgatttatgaatttatttatgctttacaaaagctaaagtcaaatcacattcccccatatatttaacaaatcacttttaatgaaaagaataaatgccccttaatcagaattgtcccagatgatctaggccatatggttgttacagttgactgtgggtgcagatcctgggcctgtgcacaaaaagacactcagtaaacacatggggaacaagtgaatgggaggagggttcagatgaaagaaaaaggggaaggtccctgagaataaatctgctgacatcaccatctcgccgagtccatgcttgactggggactttcctgaagctataaattacttttcaatgtctcattccaggagagaaatatccaaacgacatgtccatctgatgaagagaacagtgtacatgcacacaccagatgcatgtgggtgcagctgcccaaattgcagccagtcaagttttatacctgactggcataaaacttaatcaggctccagtgttcagggccaaaagccacaacaaacatttcaaagtcaggcctcaccctccatctcacagatagtcccccagctgcccacaagacctggactgattgggtaattgtagaaatccacatccaagaggttgaaatggcagaactgctatgaagcttgtcccagtttttcgattctgccttcaggcagcaacaatcctttcagttgcttatctcaaataactaagtcacctccactgaagaagtgcgatcaaccacttgtaagaaagcaaaactccacaagcatcctagcatcagggcccactagttgactccaggatgagtgcaatgatctctcctgggtaccaagaagactccatccagagagagggcagataacaaatgtccatcttaggtcccttgccccccatccaccatctcctagtccctgggacctccatctaagaggagaagcaccagccttggcaatggaagcccacaccagtaggggctggccccacactgatcctggtaggttcatgcttatgcttctgcctcatgctgaactagtgcatgcctcagccctttggaaccccttggagctctccaaggtactgaccctcattcctggctgggcccctaaaaacagtgtcatggtgaaatgtggttattttgagtttatatatggttacagtcttttaaaaagaatcaattcaaaataaatttggcttcactgttgtacctcattttaagaagtagttttctaacttttcacctccaatttatagtgtggatctctttaagaagccaggtggcctatgtggcatgtggcttatggatttgcctgtaatggccctgaagcctttgacatcaccaagtcctcactcctttggatcttgcctgtcctatttcttggccttgtgcccttcccaatcccttcctatcaactgcagactcctaggatgcccttttccagcccttacagggcactatgattgtttattgaccagtttatttcccccattggcctgagtcctccaatgaccagattttttttttttttgtacctaatgcagggtttgtgtcacctgggtcctcagttggtgtttattgcccagtgggcagctagtgaatagtctcctgggtgtgacccaggagatcttccatctcttaagcccttggcttttcctactccccaaggcccactctggcagccagccaggtgtgctgtcctcccaatggtaggaacagtggtctgtgctagtctcctgctcataagaaacttcaggatccatgtcttctgcttgcttgtttgttgtatttcctagaggaaaacagtctggtgttaaccttgggttttactggctacctcaccccatagaaacacaacaataacaacgaatgcttctttgaacaccatttttcactattctaagcattttatatgcattaattatcagttacatttgctgttaggcaaatgctaccacatcctctttttacagataatgaggcagacagagaggttatgtgactcacttggggccgcccagctggttagtgacgggcccagagcaccctccagagacactgtcctgaaccatcgtgctgtgctgccacccactgagcttggagcaccacggggagggggtggggaaaggcgaaacgtcaggagagggtgagaaatgggaatttggaggcataaagtcaggaaaaggttgagtcctttttataataaattcctaaaagagggaatacgaaaatcgcagttgctgtagttgtacagatgagtccttatctaactccatacaattaatataaagaaccatataattaatttacaactggaaaaaaaaatactttattctaaagatgagcaagcagaggcccagagaagcccccgagtgcccaagttacaaagaagagtgtccagaggcactggcttaagaagacagaaggcactcagttgaaccatttttacaatggtataaagaacccccaaggtgatattttaataaacaaaatgacccaggtcattaatctctctgctgctttgagacatacacaggtgctcccagggctgaggctgtggaatcccagccagctatcctctagggggagctagaggcagtccttccctttaaacagggccttcattaagcaaacttaacaaacacgaggagcacaaacagaaacctctttctcagcttgcaacggacagatgtttaataagatgccatgggccgggtgcagtggctcatgcctgtaattccagcatttggggaggctgaggagggaggatcgcttagggccaggagttcaaggctgcagtgagctatgaccatgtcgctgcactccagcctggagaacagagcaagactgtcttaaaaacaaaacaaaacaacaacaaaaacaaaaaaataaataagatgtcatggatatggaataaatagaggataaagcccactgaggaaatgcctgaattctagacaatctcagcagctttcttgcattcctctggaatgactgggccacatctgtattgtgttcccatctggacacttcattttaagagtgatagtgacgcatttatcctgggaagggaaattagcaaataccaaggctggtagggggtggggggggacctgggctgctcaccccagagaagactggccagctgggctgcgaagccaccactccaacagttccctgtctgtgaaaaacagagtgtccccttccctgagggtgcactcctccttgggggtggggggacagataagttagaactgccaaggttctctgctccttaaatgcagcctagcaggatgggtggagggggtggggggcggtccttgcagcactcagagccaagcgctttctggacctggtaaagtgcctatgcactctggggcctctgagactcctacagcaagaaggaccttagctgtctccaggccctgatccaaccacttcatttcattttatctattttattttattttatttttgagatggagtcttgctctgaagcctaggctggagtgcagtggtgcgatcttggctcactgcaacctctgcctcccaagttcaagcgattcttctgcctcagcctcccaaacaaccccttcattttcgagatgagggctctgaggctctgggttccatggccagtaagaagcagaagtgggactggagtccagtcatgcagccccccatcaccctatctagtcctcttgccatttggcccacagcctccaccagcaggagcaacactaggcgccaatcttgccctgtctttctggtgatctggaaacagtcctatcatggcagctggaaaacagtggctcacactgctgccaggcaatgttcaccagctggtcctcctcccaaacacactggcaagacctagtgacacacagggtgcctgagagactgtgcacccacataccgccttgcaattgtccatccccagccattaacaggtgcgacttctctccgcaggaccacagtggatagaaatctctgtggaaatctcctcttggctgctagccatagaggacagatcttctacgccaaagggagaaggctgagaaccataaagccatcaagtaggagggaccatgcagtgctctctgatgcccaatatgtaaccataatacatgagagaccattaaaggagaagagctggggaaccccacccctgccccatgccatacaactcttcctaaacacagggtcttcacagccagcctcgacaagagacacatgtagaagggaaccatgactagccattccacagaccagaccagcacagcctgttgtggtggagacagtagcttcttccccaaccattcagcactgcggcctgggcttcctcacctacagatgtctagggctctgatgccttcctgtagttacccacagcagcccacagcactgccctttctcaatctcagcctcctccccacccctacacggtccatcctccagtggtgggggcttcatctcctgatggtcttgaccttgggcactcttatcttgctgtccaagggaaatccccagaagacactgagtaatgagagctgagagaatgggaccttgcttttaggccatgggtgaaattcaagccccagtacgtcatgtctgtgaggcttgtggaaagctggcttctgagtgagtgtccctcagccagcactcagcagacatttatctggcatgacctctgcgctcacactgccagggctggagtgcagagccacaggagagtggggtcacgtggggacagttcttcccctctccctaccctgtgctgtatgaactatatccatcacctcttttagctctcatgccaccatggtggttggtatgttcccattccacatatgagtaaatgtagacccatgagggttaagggaatggcccaaagtcacatggctaagatgcagaaccagaacttgaatgcaggcccggcttccctaaggctagtgcctgccaccagattatagccatgaatcttgcataacctgggtgaaacgcttttccaaactctatttcaaaattatgagttggcctaaaatatgactcccacagcatgctaatcttgtaattactattcatttatgaccactctccattgcatttgcaactgaaagctttattatgcattagtgtgtttcggttccacaaatatttatgtttccattccacaggtaagaataggtacccaagaaattcttttccccattttaaaatggagagttgctcctttatgaaagcattcctttcagtgaatccatttattcaactgcccattgattcaaaagcatttactgagtgtaaaaggcatacacgttatatgcatgatatgcaaaatcagcactgctctgggttttggagatacagcagtaatcaggacagataaggttcctgctaaaatcaaacttaggttctagcagaggagacagacagtaaataagtaaataaataaataagatggttcaggtaagaggtgctatgaagaaagtaaaacaggatggcctggggatgtaataagaggtaacatctgaactgatacctgttacctgctgactgaaaagaagtcagccatataaagattaggtgaaagaaagttctaggcagaagggggtcaggtgcagtggctcatgtctgtaattccagcattttgggaagctgaggtgggaggttacttgaagccaggagttcaagacctgcctgggcaacatagtgggaccctttctctacaaaaaataaaaattagctgggcatggtggtgcatgcctgcagccccagctattcaggaggctgaaacaagaggatggcttgagccaggagtttgaggctgcagtgagctatgatcacaccaccgcactccagcctgggtgatagagtgagaccctgtctcaaaaaaagaaagaaaaaaagagaaaagaaaagaaagttctagacagaaggaacaacaagtacaaagcccctgaggtaggaatgggaatggtcacagccagtgttaatgggacctagacagttcaaagggaagcaggggaagatagggaggctgacccataacaggcctcagaggcccatggaggaggcttagcttttatcctagtggcatgtggagaaccaggcatgaaaacacatatcatgaatcgccaacaagtgccgtaggaatcgatgcttttttattgttttttttttttttattgttgttgttgttttttgagacagaagtctctctctgttgcccaagccggagtgcagtggtgggatctcggcccactgcaacccctgcctcctgggttcaagcaatcctcctgtctcagcctcctgagtagctggagaaccacatccccaaaacttagaaatcagattgccttcagaattaaaccactgaagcccacgtgccgttgatgcaattagtcacctgttggttctggagtaagtccccaaagagctgtggagcatcctaaactaatcaaggtggccttggaagcagggccagtattagtatgtagaaagtggcagtaccagcatttgaacccagttcagcctgactccacaatcccaagtcttgtccactccagcctctcagtagcttccataaagcttagacacatagcacacataaagataacatggagaactgttgccagcattgaacagaaagcacattcttgtgtggcattttgcttatggcacaatcggggtgggtacatggaaggcagccatggagtaggccattcaaacctggtgaaacaagaagtttaagtgtttctcttatttcagatcaaacccagaaggcaaattttcattaactaacaactaaaggcatctgttacggctgggtgcagtggcacactcctgtaatcccagcactttgggaggtcgaggtgggtagattacttgaggtcaggagtttgagaccagcctggccaacatggtgaaaccccatctctaccaaaaatacaaaaattagccaggcatggtggcgtaatcccagctactcaggaggctgagacatgaggattgcttgaacccaggaggcaggagttgcagtgggctgagatcccaccactgcactccagcctgggcaacagaaggagacttcagcctcaaacaaaacaaaacaaaacaaaacaaaaacatagcatctattcttacagcatttgttggtgattcacgatatgtgtttttatgtgtggttctcctgcaagccccatgagaaagaagggctacaaacttgcattcctaacacaccacttgcttcatcttgccatgctcttgccctctgctagcactgtccacctggaaaactcgtccccacccttccagattcagctcaagtgtcagctcccataagatgtcttcctgaccatctctacccacttttaggccaaatcaatcacttctaagcacatctttttgatcaactcatcacactggatgcatctggtggcttaaatgtctgccccttcctaaagtgagcaaatgaagagcagggattacatcactcactgaggaattgctggtgcccatcatagcacttaacacatagtaggcatttactgaatgcttattgaggagcccgctgctggctgagtaaggttttcttgctactgctgataaatggcaaagctgagacccacatccaagccttagaccacatttttcggccatgagaaatggctatataaaagtagctaggtcaggacaaaggtgatggagacatcagacagacaataatttggggtggagggaagtgatgcagagaggaggatggatcaaaggagttgcaatgaaacctgacacagcagggaaaaaaggatggggccggatggggcaggacatggcagaaaacggggtggaagtgagccagaggtgaattacctgaggttccttacgtgggatgctggagaaatgaggacactgcctgctgcatggctaggctgagcaggggatgtgggcacactgaggaagttttcttcacatattcatcttgggttgtcagtgggatcccaggtcaccaggaggacctgtggttcaatgctccatttagaggtatgtttaacttctgataattacagccaggaaggtgacagttaccccttgctaaggtggacgaggagaaatgagagcttccaacagctccagaaaaggtcttttacaaatcacaaatcctcaccctttaggcatcaacatggcttctgaagcactactgggaggttaccttgtgcaatttctggagatgcactactccctctctttccaaatacccacaggctgccttgactgagtgcagaactgccctctttgaagaaagcaggtggggagggaggaacactatggaaagagcatgaactcctgagggagactggcctgggttccaatcctgattccaccctcttgagctgagtgactaggggccagctctactgtccagtcaaggacacctcagcaatgtcacaggcatatgaagactgggagaaggcatctgcgatgtctaaacacaacataccatcaatttctagaatatacaaggaactccagaaagccaatcagaaaaggacaggaaactcaatttaaaaaatggcaaagcatatgaataggcaattcatggaagggagaatccaagtgggtaacagcgtatgaagagaccttcaaatgtactagtaattcaaaaacccaaactaaacacaacaaaatactaataaactcccacaggtaaatattaataatgcctgtgttggtgagcagggtgcaaagattcctgtttcttcgtgtcctgctggtgggagttcaaatggattcagccgttctggaaaacagtctgcagtatatagtatttcttctttgtgacccagaaagctcactcccagatgtaaatccctgggggcgggggcattgatgaagaaatgtgttcaagtattgtttctcttagcaaggactgaaagcaacccaagtgctttagactaggggtgaggataagaagaggttatggggggatgtgaaacaccattgaaacaccacgcagtcattggaagcagtggcctgaaagtacaaggttgtggggacattggacataccataccgaatgaaaacgaacccagtcagtagcagatgatattattattcccgtctataggaggaaataggtattcacatttagcacactagcccatgcactgtggagatttaataaatgctggttctctcccccttgtgcattccaacctctgccccttcttcattccctccccacgcttcctgagtggcatcccaagctctccaggtagtttaagcattgctgtggaaggtgagggagaggtgttaagtaattctggggcaaccttaactagagaaagagttttaaaaatcagagtgaatgaatccttgtcctgaattcccagagcctcatgaaggaggcagtgtggaggtatgggccggaagctattatcacctccattttaaagagatgcatttaagtaacttgcccctaagatactcactaataaattgtagaatcgttgttaaaattcaggcagtttgaattcagagcccactctcccttttttttgtttatttgcagattttatttcatgtctgtgtgtgtatgtgtgtgttgaaatctttcaaatatacagaaatgtacagagactaataaaatgaatacacttcgcccatcacccagcactctccagtgctttgccatttaaccacaaatcagtttcattctcagtagtgtctaattgttccatttgtcttttttttttcttggtctgtcttgctaaagaattctttatcttttgttttctgatttagttgctcttttctattgtctctttattttctattttgttaatttcccttctgctactttctttgaatttactcttttgttctttttcttacttcttgatttgagttcttctttaccaatataaatatttacagctatacatttcctctcagaattgttttagccatttcccactcattttgaaattcattcaaatatataatttccgctaagatttcttctttgattaattatttcgaagaatttttaaaatttcagacttatgggggattagttatcttttaattattgatttctgattgaattgctttgcggtcagagacatatatgatattgggggtttttcttgtagttagagatgtttatgatattgggattttaaaaattagttgacatttgctacatgattaatttttgcaaatgttcacatgtacctgaaaagtatatgtactctttaaaaattgttaagagtcaggattttatataaatgctttagatcaggggttagcaaatgtgctatagtcaagactttcagctttgcaggccatacagtctctgtcatggctactcaacctgccattgtaaagcaaaagcagccatagacaatagccatagaaaataaggaaataaatgaatggggatgtatttcaataaaactttattgacaaaaacaggtggtgggctggaactggcccaccacctgttagatcaagctttttacttgtgttgataaaatattccatatcccccatacattttttgtctatttactctgtcagttgtagagagagttatgtttaaatccccctttataaaaacgtatctgtccatttctacttctcattctgccaatttttgctttatttattttgaagttatgttattaggtacaaacaaggtcagaattgttacgcttcatgaacccctcttatctctatgcagtgatctgttttatccccagaatgaccataggtccctgtttgcctgagatagtcctagttaacacatgctgttctcacaggtcttattaatagcacctcttatattaatacatgttgtccccatagactttactaatagcatctcttttaactctgaaaagagtcctcatttgaacaactgattacatggtcacttttaaaaaatatccttaatgttctctgttctccaaggataatgtagttatttcagctttcttttggtagtgtatgtctgagaaatagccatccatttaaatccaaatgttttaaataattgttttatatttacctgtcccttgaattttctactgtcttttaggtaacagtcctgtggtcactaagacacaacatacaatatcaattttaaagtgtctagtcctagatattaatccattaaaatgttagctccacgaaggaggatatttttatgtattttgctcacggctaaatccccagtgtcaaccaatacctagcacagagtaggaactcaaatatttattgcatgaatgaacacttgaatcttcaattcaaagtaagaaatcctttatctctacataggcaagttgcaagtggttcctaccctccctagctagcacctgtgacaggtgggaacttggggtcagggaaggaaggtacagtgtgctgattttcccctttcccctcttgccctcagattatgaagcagggctccaagctcctgaggggctggagcccagagaaggaaaggaagcagagccgtaaagctcttaggtggctgctgactgataggtgactccagcttcagagactccccagttgtggtctggctgcaaatcccctggggtagaggctgtattctatccctccagctttcccacctctcagccccagaggtcctcatcaccggtcctcactccgtcttctcaggcaggtcttagatattagggctcccatctgacttggcataatctgcctctcatcaatcaaatgtaggcatgcatcccttgtcttgctgtagtgggaatggaggcacttctcaaatgccatcctctatttcatcttccatgtgtcaaagaccactcgagctttttgggcctatgtcaagcatcggagcagatatctctcaactgcaggacacaaaaccaggctctctgagtcattctgctgaagggcttcccctactccaccccagccccaaacatactataagttgaactgagagatgaagcaccatctcacctctctccacaatccaaaagtcctcctcacaaaatcctctcttcaaaatactcacccagatccctttttacatattggaaagaagccctacttcccttagttcccaggcactgtctgaatccttcccttagaacaggaactagagagatgggtaatgggtattcatcatttgtccagtctggtcctttggctgcctgagcaaggtgagagaatggggctgggccttgggcagcctctgtctacatcctagtcttcagggtctcacttgctttaattgtgttgatcatgctgcaacaggacattcccttgggtcaggtatacatccagcctacgtggagtgctggcatcaggatgcacaggccattttgatgtgaaggtcctccttcatttatccattgctgcctaacaaaccactccgaaatgcagtgtcttaaaatcatccttttattgctcccaattctgtgggttaggaattaatgtagggctcagtgagggcagcttgtctctgctccatgtgttatggctagggcagtgtgactcaggttggagggtcccagcggggcactgaggctgttgtctgtgtggccactctctctcttcatgtgatctctcatcctccagggcctctctccctatgttgcctctctccagtaggaaaatctgggtttctttacattgaagttgggttctgaaagaacagtagtataagccacgaggtctcaaaaggtctgggcctagacctggcacagtgtcacttcctccaaatcctatggacaaagtgagtcaaaagccagcccaggttgaagggaatctgcttctggatggaggagcagcatatgcagagatggatgggggaactgttgactgccatccagaaggactgccactgtccttctttgattgatgctcatattccttgctaattgcttagaatttttttcccatccttttcacagggatgaagaaagaataagagtggttagaggttcttctggcctaggtctcaggatgcaagtatctgtcacggaagaagcttcaagaaggcagttctgcattttttcccagtccagctataccatgacagtccccagatttgggggttatcagtgtagtttctcaagctttcctatatttgctttgcatcacacaaaactgcttggtctgggaaggggacctctccatcaactccaagcgtcttcctaccatttgatctgcattgttctggatctgggaaatggctgttgacagctgcagaatgcggcagggacccatccttagtttcagcattcatgttctagtccttgttctttttactaccttttgattatattgtccaattccacccttcatgacgctatggactgaattgtctgccccacaaattcatatgttgaagtcctaactctcaatgtgactttatctagagaaaggctcttaaggaagtaactaagtttcagtgaggccataagggtggggccctaatctgaaagggctatggccttataaaaagaaggagagcaagaaggagatctctatctttttccaccatgtgagtacatagcaagaaggcaaccgtcagcaagccaggaagagagacctcatcagaacccaaccatgccagcgccttggtcttgggcttctggcctgcagaactgtgagaaaataaatttctgttgtttaaaccatgcagtctgtggcatgctgttatgacagcctgagcagactaatatacccaaagactgcattgtatgcttaatctcctcacaagaacaccaagatgcagatacaaaagtccccagctcacagatgaaagaaatgagacccagtcttagttagactgacttgccccaggttgcacagtgagtagcagataagaacccagttcatccagctccaaagcccatgttctgtgccacatgccaagaggctttttggccatctccttgtaatttgcagtttggaaagaaggcggagtccctgacttctccctggctgctggctgtttgctcctggctctgccctctacctcattctacactctccacaggcataagcgatcccagagtggtgacctcaaggggaggggcagggtgcagagaggaattctgcctgggctgcacattccttcccagcctctggggagggcaacaaagaaacccaattagcacaaagtgtgtaggtgggtggggagacagccgcttttgtccttccttctggtgtcactgggggtacacacagcttcgtttctaggcctggatcattccaggagggcactaggactctagcagactcctgtcaatgacacaaaagcactgaaaccaaatattttaaaaatccatttatttctgtcttggcacataaaagtctggttacttgctattttagagtaggcagcagaggcaaataagctggcttgtggactctgataacagaattaagctgtagtggaagcaccattgtgtaggacttttcagtgtttcaagcactttcatactaatctagctttatcttcatgtcagaagtcaggggagtgagtgcttgcatatcatattcccatttcataggtgaggaaatgaagacacagagaatgtaagaaactggtcccaggatacaccaagaatccccccaggccttctcattctgaatgctacactcttttcatccccaaaggctccgtcaccctggagatgcatattgtctttcccccaactgcttcaaatagtcatttccaccatttactttccacagttccttctcttgtttgatcaaaatttcaatctaacattttgaaacttaatacaatctaccattttgcaatttaataataacctagtctagtcagaaaggtaatgcctccttttcagttcaaaacaggatcacacagctaacgttgtaagtggtccggaccccagccctggcatttttccttgtgacccacacaacctcgctgtgcactgacaacctcaacaacccagttaccacttaagaaccctcaaacatccaagctgtttgaacaactggaaaaggtatgtttgtgtctgatctatactgtttttcgtgacaaggtagtccctcctaggaacacaaggaacattaactcacatgaacaggaatcagagttaacatttatatcaccagataccaagccctgttccaagttaaatatatatatatatatatatatatatatatatatatatatatagagagagagagagagagagagagagagagagagaaagagagagagagagagagagagtttatatatagagagagagacagagacagagagagaaagagagacagagagatggagttttgctcttgttgcacaggctggagggcaatggcacttctcagctcactgcaaactccacctcccaggttcaagtgattctcctgccttggcctcccgagtagatgggattacaggtgttacccatgtctgtataagagaccacctgaccaggcttagtgtgagcaacaaggctgtttattcacctgggtgcaggcgggctgagtctgagaaaggagtcagcgaagagtggtgggattatcattggttcttataggtttgggataggcgttggagttacgagcaatttttgcgggtagggggatggaagttacaaagtacattctcaaggcgggaggatgttacaaagtacattcacgagggcggggagggcatattgtcacaagggcagggaagaatgttacaaagtacattcacaaggaccaggaatatcacaaaatacattatcacaagggcgggggaatgtcaccatggcttgaccatggtagggccagcttagaggaccttacaacaggtgctcgccaccacgcccagctaatattttctattttcagtagagatggggtttctactgttggccaggctggtctcgaacccctgatctcaggtgatccacctgacttggcctcccaaagtgttaggattacaggcgtgagccactgcacctggccaaagtgagatatatatatatatattcatttaattctcactatatatattttttgaaacagggtctcactctgtcacccaggttggagtgcggtagtgtgatcacagctcactgtagccttgaccaccccagactcaggtgatccttccacctcaacctcccaagtacctgggactacaggcgtgtgccaccatgcctggctaagttttgtatttttttgtagagacggggtctctccatgttgcccaagctggtctcgaactgctgggctcaagtgatctgcccacttcggcctcccaaagtgctagaattataggggtgagccactgcgtctggggagtctcactatttttgacctgacctcctgggaccccttggccccatgagcaactccacatccctgtagccccaagagagtaatgagtaatgagccatgatgtgaagatgttgcccaaaactgtgcagtgcatgacctgtgcaactggacatggctgccctgctggaattgtcactgttactcccttgctctgacataggactatttgcagtctcctctctcataagtggggccaccctgcttcttttccagaacctgtgagccattagcatgtctattgctcattaaccgatattttgtaaaaggcttatttctcttgtatataggtcactgtcacagaggtaaggggctgagaactgcctgtcactgggagaggctgagtgaggaatttagggtctccaggaaatgggggatcctaaacagcatgcttgattttgcattagtagcagtactcactcagcgcttcaagtgtgcttgcatgggtgtgagatgccctgggtgttttgtttgtttgtttgtttttgagatggagtttttgctcttattgcccaggctggagtgcaatggcacaatctcagctcactgcaacctctgcctcccaggttcaagtgattctcctccctcagcctcccgatgtgaactggacagtctgacttccagtgggggccctcacagacagggcacggcttaggaggaatcccaggctgtgagcattccaaggcccagtggccaggcttttggcatttgaagcaaggaggaggttttgaaggagcccctgggaactgtggcttggatgttctgaaggttttgtatgctggagacgtggttgtgagttgtcttacagttcattcattctataatgaacctgtattgctttaataaaatcagggagaaatgttactgacttcaaaacctgcttgggcaatgtggactggactaatagtgactgagccctgccatgcacttggtacccagctggccaccttaactcactcattcttcaaaggaggacttattactgctgttttacagatgaagaaactgaagctcaaagaggcatggcctcttccccaggtcccatggagcccacattcatctgcttaactctaaagtcccagctctcttctctacctggagctctttgctgcctctatggtagctgaacaggagaaacacccaggaagatggtcaccacgctgccccagagcccaggggaccagggggctgctgacggccataatcagggtattcttcctgaaacaggtaagcgacatgaacctggcccaatggagaggcactttcttgttccaccacaaatctccattaaaatcgccttttccatagtcaccaacagtaccttattgatatccttctggcatcacctaaaacctaaaaacagcctgacagtttttgtgaatcagtttccattcctcatcctcttggctggcttggtgacacctcttccctgctgctgtttgccaactttaccaatttaccatcacctgcaagtgaatgaccctcttatgcctagttctagattagttggattttacattgtttcaaggtatcatagaggttccagggaagatgcctgaggcactgctggggagggggtgggctggggacagtgaggaatgggttgagtcaatcccactttcccctcccccatcctaaccaaagcagctgtttccatctttgggtgaatactgccctttatttgagaagggatccaagtctataggctgataggggggccacagatgtagatcattaataaatatattaaatgctccagtaattaaattattccagtagaaccacatcatagtgaagaacatgaagaagattttttttcaaggctgcacttacaaatcattgatccaaattcactgggcaatttcatcaggacctcccttttccacaggcttcttgggaaaaggatatgggcagggcttggggggcatggggtaaagtagggagagagagtcaatagaggaggaccccagagggacaggaggcagggaagggagggaagagggagaggagaggcagagaagtcagagtccttgtcactcctaggacagctctctggcttcttcacacactgacatcaaagaacacctttgaaaagtgaccattattttatttataatttcccaaccagtgaagaacaagcttctgccagcaggagttcctgggatgatgccgggcttcccctgcaaccccagtatggaagcagtcactctggaccctagtaaaggagctggtgtagttaagagtttagagggtccttgcaaggtcacagccctgggtggccacccagtgtccctgctggacagcaggactccccgctgcccctcacagctgcatcatcatgtctgcaattcgcagatgttcacaatgatctttggaagaaactgccttcctcagagccaagttctaaccacaccagggatttactctccttatttagaactcctaactcacttttttgggaaccgtccaaatggcattagctacttcagttgataaactttgccttttgactgtttccaaaatatgaccccctcctttaaaagatgaatggccttccctggggatttcttagacaagaggttctgaaggcatttctaagagatactttaagccagtggttctccactttggctgactgaatcactgggaccagaaatttatgtatttggtgctgcactcagatggtattaggtacttccctgcacattaggaaaatctgtaagagcttcattgtatagatgaagaaatggaggctgatagtgaacaggtgccttgcccgagaccttagggtgagaagtgccaactcaggctcctcaaatatcatttgtccagccccctgcaccctggccagtctcctaattctccatccagaatccctttcattgtgccagggcttgcacgtagtgcagctctttaaagtctagttcatggcatgttttatctggcatacacaatattttataaaagcccaagtgagtcagctaaaaatcagaatttacagtaaaaatctgtaattctggccaacattgcccaaccctcctgcaaggcagagttcacctgagctggctcaggggtggcctcccttgatggtccaggctctccaggagccacccctctcccaccccacccctatgacccactggcttggcctgcctggccaggccaggcactcacatcagtgacccggcactatatcatgaatggagtggaagcgtcacaggggtattattccatggaaacaatacccacttcgatatggcatgcttactaaaaaagtctttgcttttatctaaagacactgcaatcagacctgacacacatttatagaagtccagatgatgatgacacaccaaaaatatcacattgatgtagtgttttatcactttccaattactttcatgtatatcaatttatttgagttagaaaatccagagaattcatcctgaccttccctctctgtctccaccctacctctgttgcttatcccaggccctgaaaatggcccagatataaatccagaccagcggccattagacagacaaacagaaacctctgtgcatggaagtcattgttctattgcttctcagaaatgcagaattaaggggcggggggaatgtaaccccaacatataataaatacaattataaataaataaattaaataataataaatataacaaaacagcagatgtaaatgacagaagcaagcacatacaaacctagcacatacaaactgataaaaactatgaaatatattcatatacattgaacaaaggtcaaaagtaaatttgaagagtccatataattttagacttgttagccttttttaaaaaaaaatgttgccttcatgttcccagttaaaaaaaaaaagctcaagaattcttaactttctcttataatttcctcacctgtaaagcggaaagatctgtatgtaattttcagaacagtataagcattcaataagtattagttacttttattatcatttgcatgtacaaggcaatctttccaatttccctccttcattttcccagaaaaagctaatcaaatgggtttatcagcttccatgatctctgtgcattgaatgaaggtgaacatattcaggtgtgatgcacttcatgtcaaggtctcattgaccccgtagatttgaatgctgaagtgaccatcatatccatcacagaagaagtatttttgtacaattcatcagctggaagagctacatggaaatacatgtctaactatctctctgtctacttgtgtctccacaaagtcctgcaagctccaagatgggaaatttgcctaattcatttctgccccttcagtgcccatcccataagttggaagtcagtaaatgtcaacaagtatgtgaccaataaatgaatattcaaacaaggcaaaaataagacaggagaaaggtgtttttatgtccttcagtgggagaaacctgcaagcaatacatctttggtgccctgatgacaggctatggtggatgctgcggtactgcccaggtcccctccagcatggagccactcattcttctggctgctgggaatgttgtctgctgacagctcacacttgagtctctcccaggaattctgaagggagctgtgttaccaaggccatacacctttcccaaaagcagtctttatccactgactgatcactcgcacagggacaaagacctggctcctttgccgcaatgtgggacaactctaaagagccatttcagctccagaactctgtagcatggactcaggcccttgttggaattgcatcacagttcaacttttccctctcccccaccctgtgtccctcccaccccagtgaacttcctacacatagatccatcatctctgagtctgtttctgaggaagccaacctgtgacagtgggtaccaggagtaagagctgggaggtgggagtatgttggctcttgctggaagcttcttatccctacgcgttcgtgactcactttattcatggcttgtctcaaatgtactatctcagagatgacttctctggcagtgttgtccaactattcccaaatcattgctagcatatttccccattttgtctcctcctatgcagtcatccacatctgaagtcatcttgttctttttttcttattgttttttctcactctcacatgaggatgtgaactgcagaggacaaataccttgctatactgctcactactatctccagcttctaaacagcacccagcaccatgtaagctcctaagaaatatttattgaatgaatgaatgagaatctgcacacacattcatagtgggaagaactgggctgagagtgggaaaccctcatttccagctctgtttctgccattaaccatctgggtgacctcaggcaagccacctgacttctctgagcctcagttttctcatctgcggaatgagatggtagaatgtgatgatcactagaaattgtgacagctccagcatcctataattttacatggttattcagcttggaattgttctgtctataaactacattctatgggaatcatacagttttttatgctgaaacggagcttcccagagcatttcacaatatccaatgagtatcggctttcagatgccaatttcattattataccaatgctagaaaaactttcatgtgagacgctgcagttaaggatatgttcaacatggggttcatcaaagctttagagcactgtgaaataaccattctcctatttgcataaatatcatgagaactaagtctctttctcaagtcccacgaggtaatgaaaaagtgaacactggttgaggctgcctgtgcaccaggcatgagtctgtgctcatgggaggcagtgaacacctcacctggcctggagcaagcattcaaggaatgctggctcttaacatctgtctcatttaatccaaacaacagtcagtttgaggtgggactcttaaccccaccttggagttaaggacacagaagcactgagatttacctaatctacccaaagtcatcgaactaataagtaagtgatggagccagggttggaatctggacagtcagggtctagagcgttgccatttatccactacactagagctgtctcaattttcttaaaattcagattctgaatcagaatgtttggggtcagcctcgagatctgcatttctaactatttctaggtgatgttgatgcttctagcctatggctcaggctttcagttgtaaaagtacagaagaaggaactcctgctaaaagtcagaaactagcctctggtccagccctggcaaatgctggcaatgagaccatggctaagtgacctctcctcacaggctcactcatgcctgtgatcccagccctttgggaggccaaggtgggaggatcacataagcccaggagttcaagaccagcctgggcaatgtggcaagaccctgtctctacaaaaattttttaaaaaattagccaggcatggtggtgtgcccctatagtcccagctactcgggaggctgaggtgggaggatcacttgagcctagaacacagaggctgcagtgagccaagatcatgccactgcactccagcctggatgacacagtgagacccagtctcaaaaaaacaaaaattactgggtgtgtgtgaaagcactttataaaccagaaaactcaaaagcaaggggacagaaatttgcttatccactcgtctttttccctctaggatgtgagtctttgagccagcacaaagcagtggtgcctggcacatagtagatatttagtaagtgttcaaagtgccaagtactttaaatgttatgtaatttaatcttcacaacaatctctgattcacattttacagataaggaaactgagactgcctaatacaccctcaaactactaaagcagtaaatgctgaagcccagattttaaatgagatctgtctggttccaaaaccaatgctgattttaccctccactcccattattcctcccacataggggtctggctgaggtctaggaatggatccagattttgcttctgcacctgtcacatgggcactgggagtccaactccttcttagaacaaatgagggctctggtctagggacagatcctacaaatgcaagtagaagctcttcattttaggggtgggagaaggcacggaaataattcagctaaaataaacccttcaagtattctgcaatgagaagcaaagtcaaggtcttcctattatcagggcccccaaagccaatccagaatgtacaggttcaacaagttcaaaggagcaaatgcctggaacagtggctctaaaagtggggtccaccagggtctctggatggccctgctgaccaaagtattttgttcttgacattaatttatagctccagcattggtaggaaacttaggggtcatggagtgcagcttcccacacaatgcaaagccacatgagggggctggtttttgaggtcttgagtccactgaccaactcaatttgaggctcaatggcttagagaaggaaaaaaactaaagtaagaggttgatactgttcctatcctagaggcaaggaaacaatgctcagaaaggctaaggaatttagtccaaagcacaaaggcacgaatggtagagataaggcctgaacctagggacaactgactccaaagtctatgccctctcctctgcccctccaggattgtaattaccattataaaagcagcagaatctgagggctcaaggaggagctggacatggctccagagcctctcctgaactctgctggcatcaaacatcatgatggacacaagaagcacgcctgagcccacagtgataaggtccacacacagtggctcctcctttccccaagtcattctgtgggtggtacccagctcatctggataataactaaccacaagctgaccatggtggaaaatccaagatctgataaacacacaaaggaaaatccttcaaagaagctaccgagcctgctcagcgtgggagcctccagcttgtgaaatggcgagggggtagtattgtgacccagacttgaccacctggtgtgaccctagcaaggacctccctcctgctccctgagggctgctttcctacctgtaagaggtgtgaccaggaatccccagcatggtcacagaataagaaaggtcaagaggctggaaagggcctcctgagaccagtgagcccggctccctctgggcctggggctgggtctagcataacacaccctcatttaatcctcctcacaaatgggtcagagaagtatgaagtctttggggacaggaggggtgatggccatctgggtgtctcatcagctccatctctctgcagagaccacggacatcttcattgacacccccattcccccactgtgagtaaaccactctctcaggggaagggggaatatgtccatgccctccccaagaggaccttggcactggtgctgttctgtgggctctgtctggctgccccttaccttatgaaatacaggggtcacagttcagttttcttaacatctagtacattctccagcacaccaagtgttcagtaagtgttggctatgactggataatcatcctataaagggtctgactcaggcagaacactatagctgtaacagctccccaattcttattgaataagacagcgatgtggtggttcctccacaaagcagtgattagaattccaattgtgaggttcatcatttcatccagtatttattgagcacctactcagtgccaggcactatttggggattcagtgatggacaaaacagatataaatccctgacttcatagagcttattttctagtggaagagacagacaaacaaagacacaatacagtatcagttagtaataaatgctctgaaaaaataataaagaaagatgagagaatgaagtgttgggaacactatttgagatgcatggcatgaaaaggccttccaagcagagagaacagcaagtgcaatggccctgaggtgggaatgtgcttggggacaggagagcagtgaccaggaatgatgagctgagaatgaagctggagcagcaggcaggggtttgggccacagtggtcatggcaaggactctagattttattacaaattccacgaagccattgcagggttctgagcacagtggtgaggccatctggtttacatgatctggggaccagaaggactaattcttagcatgtaagctccaaggaaatgtaagtacattaaagaaaccctaagtacatggagagtaacttgtttgaaaatactattgtcttagcctactaggactgtcatcacaaaataccacagactaggtggcttaaacaacagaaatttatttttttcacagctctggaggctacaagtccaagatcaaagtcccagccaattaggtttctggtgagggctctcttcctggcttgcagacagccacctcctcactgcgtcccagcatggcctttcctccgtaagggcatgcaaaggagaaagtgagctctctggtgtctcttcacataaggacatcaatcctattagtgactcttataaccttatttaactcaatatccaaaaggtgctatttccaagtacactcacactgggagttagggcttcaacatattttaaagtaacacgattcagtccatagcgtctagattcctatcaaattagattttacaaaatctgctcttccatggttaacttcagacaaactgatggacaaaaccaatggtgaagtcagagttagtcaacgcagaggaaatggatgtagatcacgctaatattccttagggcagtagctctccgccctgggatgattctgattcagaagtgctgtggtagggcccagggaaagtgcattttaacaagccactttgacagactgatgaacagtggacaaatgcagtgctccctgggcccctctaagaagcagtaccaaagataaaagttaatttcaagtcactatagatagagtattatgcaaataaaagattattttttatgttcctcacactttcaccaaaagaaacagatacccctaacctgccatatgagctccttcttatccacctgatatttgtctttctagattatgtgatttttgtgaacaggacagtccatgaaccctgtggctgctatgtcttcagagattacaggcagctctcagcacctgagctttcgtgcatgttttgagtcccatgatcctctggccatgactaggccaagaatatgtgcacatgccaaagacaatgaccttcaggagagacgtcaaggactccagctgcctcagtcggggcctggctgagccctctgccccgcagacttgccctctggtgaaccagccaatccaagcagactgtccctgctgagcagctgggagtgtgagacccagagagagaagaacaagggaggcatggctgcaggagaaggacaggcagagagcacagctgggtcaggttcagcctgggttagtggctggcatgggaagatgcctggtctccagagctgctgagggtgacaagggacatgctgcagttctccttgggcgtcacagggcaacttccaggatgtttcagaacgtcctcatctccttgatctccttacgagtaatcccatcaacaagacaatctgagcatgttctcagttcccacagcaagagctaagaagcagatcaatgaaactggtcatgtggattcccacactactccaaacttactgggtctcagctcaattctcatttatttctcatgttttccccttgaaggaaattcacaagaatgcaaccagtcctttggagttagttgtggtaggatgcgactggcaaacctaagaggcatcctggcttttctcatttcacccacccatgtctaaacccctagtgagtctgcagtggctctacttccaaagcatccctataacccaacaactctctccatcccattgccaaaactcaaatcatacaactatcttcttgcatgaactattgaagtggcacatcatggtcttttttccactgttgctgctctaaaatccatcccctacacagcagatcatgtccctacttagaaccttctaggagcttcccaataccaatccttaccaaagcctacaagagcctataggattgggccttgcccttctcttcagcttcatctccctccaccctttcaataattcccgcccaatggccttcattttgttcctccaacacaacaagcttattcctgtctcaggaaatttgcacctgctcttcctactgctaggaatactcttcccgacacatctgcacagctgcttccatctcatttggggtttccctcaagggttacctcctcagtgaagccttccctgaatactccagcaaaggcagcccctcagtcaccctgtcctactttttgctctttttattatttttatttttattatttttttgagacagagtttcactcttgttgcccaggcttgagtgcaatggtgcaatctcagctcactgcaacctccgcctcctaggttcaagcgattctcctgcctcagcctcccgagtagctgggattacaggcatgcaccaccacaccccgctaattttatatttatagtaaagaagaggtttcttcatgttggtcaggctggtctccaactcccgacctcaggtgatctgcttgccttggcctcccaaagtgctgggattataagcaagagccaccacgcccggcctgctcttttgtcttcttcataacccctgttagcaccggacattgccctgttcacttacctgttccttgtttaattctatctcctattctaaaatacaagacttacaggcaagcacactggctttcttccccctgaatccctagccctggaacagtgcctggtacccagtaggtacttgatgagtgtcacctgcctgcctggccagtatttattccacatggcaccacctctggggattctggccatctctgtctctcccattgccttctatcttagcaacaatctcaggaaggtggttcctctcagccctgcaggggcccaggctaagcctcagtgcattgcatatggacatctgaatacacctttgctttggaataccatgttccagctctcctttcagtccatgaaaggaacaggaattctgcccctttgacacagatggcccggtgaattccttgtattctttttgtttttcaggacttatatatatattttaattgaacttgttgagataattgtagattcacacagagttgtaaaaaataatacaaagagatctcaggtacttttccctcattttcccccaacggtaacatcttgcaacactatattatatcacaatatcagaatccacataatgtcatcgacagaggcaagattcagagcatttccatcgcacaaggatccctcatactgtgcttttataaccactcccatccctctaggctccaccaggacaaccaaaaagctgtctgttcccccttcctataactgtgtcatttcttcactccttgccttctttccacactttcagaccacatggcattgctgtcaggatgcttggctgcctcatatccgcttgtggtcggcctcggatctggcctccccttccctcctgagccacattgtctcgtccttacccataaatggcaccctgattttttaggacctgctttctaattcatcaagaacatttcagatttatcaccatcctcctagggaggcagcatctccctgtgcaaagaacacaggctttgaatcctactctctacctctccgagcctcagttttctcatctatagaatggagtcaataataccagtatcagggatccatggagaataaatgacacagtgagaggaaggactctgcccagtgtctggcacatagcaggcacatgctaggaagggtaatatgcacaatttaggattacctacgaatctcagtcagtctgcgaaacaacaatagcaactaatcaaaacaccatttcctgatgggattaaaatcagaaagagcatctgatcagagagcagatatcccacagtgttaatagctgacaactggaccaaattatcttctttcaagaagggtgtcaaggatgtcagggggttgggggtccaggaatagatcctcaaaatcttccaattgacaatattcatcaatttgctgtgtgaccttgtcaagtttctctacctctctgaacctccagttcttggtctgccacagggatgccagccttgacctgtgatttcctcaccctatgctacagggtccacagaggagggaaggtggagccctgagaaggtctctggcctccttctcctcccacctccccatccaaagcagcacccacctctgttactggctctacatatcaagagtacaggtgatctttcctttgaagaagagcctctggtggtttcagaacttgcaagaccattgtcccgatgattgctggggttccttctggttctaaagacctgcagtcctaagttctcagctcactctcacgtactgaaaacagacaggactctgcagcagcaactggtctcagctcaagcatcacttcctccaggaagcattctttgacccaggagatgaaggtagggccacctgtgggcacccccaaggcacctcctttctaagttgcccataggaggattccagggatggaactaacaaatcgcagggcccagggcgtgagtactctggagtggggcatgggatgctctgtgtgtgtgactacacatgagtgaggtaaccactcacagcccagattaatggccacgcctggggtccagaggaccccaagtgaaatgcagcctggctggctgtatgtcacagaggatttttcctaatcaaggagggaaacagagtaacggtctaccttgcttagccttgtaagcccccggtgaccaccctggatgcaaatgaccttgcccaaactattaaacattcaaaccctccttctcttattttattctcaggagggtttagagcctcactgtctgccatggttgccactagtcctgtgtgactatttaaatgagatacaatttaaaacccaggtccttagccacactgggcatatttcaagtggcatagtgacagaactgtatcccatcatctcaggaagatcgactgcacagtgctgcctaaactgtttgggaatcctgagcctggctctcgtcgcgcctccttttatgaatcagtttgccaccgtccccgcctctttgtcacttgttcctgaaaaacccggactgggttgaatagtgtccccccaacgttcacatccacccagagcctcaaaatgtgaccttatttggaaatagagtctttgcagatatcattagttaagatgaagtcatattggaatagagtagaccccaaatccaacatgactgtgtcttataaggagaggagagacacatgcatggattcacagagggagaaggccatgtgatgacaacagaggccgagacctgatgacatctctacaagccaaggtcactaaggattgccagcaaccaccagaaattagaagaggcacagaaggatccttccctagagactttggaggaagcatggccctgctgacaccttgatttcagacttctggcctccagaaccatgaaagaataaatttctggtgttttaagccatcagtttgtgctaatttattatggcagccacgagaaattaatacaggaccccatcacgagaccctacattctcatccaactctctccctcaaagacagccaggaccttcaaatcccttggatattaacccctggccagtgacacccacggagcccatcagatcctggccgtgccagccagccagtcactggacgacataaccagaggaagcttggcactggaaggaggccaggcatgctgggctggtgaggctgcctaggaaggagccaggagactcaagtagagcactcaaattccataactttctctccttttaattttaaaacaatatcagaagggttcccagaaagcaacaagccccaggccatccagtcagtggttaaacagtggagcctgatcacttactttattaacttgctaaatcaaagggctgttaaagtctctgtccggtaataaaatgcaggaaggagctgaatcacccacctattagtggcagtattggtgcagttaatgactgtagcctggagggccgtgcagacaacaacaaagccagccctgcgtttccacctacaaaccccaccacttcctctgcccatcccagtgcccccagcacacctgcccacacacacctgtcttcaagaaggctgcatcagaatctgtggtggcttgatttttaaacacacccagaatttctcctgtcaaatacacttccatccaactcttccaggatcccacctccatgaccccaaacaaaaacaaagaaaccaaacatccagaaacgcggtgtttattaaatcaattctttaaacaggcagccaacaccaagttttgacaatgcattacaaacagtgcaaagcctccggagccgaatgctctgtgaatatcagtgcagcactgataagctggaccctgaaccagtatcaccctctgaccacacagagccaggaacagccctatttattttcttcattccaccttctcctgccactttaaaatgggggagaggggaacggcctgtgtgctgttcttccagaagctggtggaaagacatgcccaaaaccgctgacttcgtccatgtagcttatcagcagggccattttgaacaagttatctaagctcagggcctcaatgtcctcacgcgtaagtgatggctccagagggagtgttcttctaagacctggtgaggtaagtgtgcttatgagtttggtacatcataagtactgcattaatattcgttgttggctgggtggggtggctcactcctataatcccagcactttgggaagccgaggcaggtggatcacttgaggtcaggagttcaagaccagtctggccaacatggtgaaatccccccatctctactaaaaatacaaaacttagccaggcgtggtggtgtgcacctgtagtcctagctactcaggaggctgaggcaggagaattgcttgaacccaagaggtggaggttgcagtgagtcgagatcacagcactgcactcagcccgggcaacagagagagactccatctcaaaaaaaaaattcactgttaatgattatgatgaataatgcacctagtatatagtaagcactcaataataacagcaataaagtgctgttattatttctaaagtaacatctaacaaaaccaggctccaagtgccataaaaactcattattaaatctttataacagatgcaactctaaaactatccaaattaaacccttcagaatattcccaggacacccagaaaagattgagcctgaatcccccattggcactaaaaacaggacccacaaaggagcctcgaagtcatgtggagccaggtttggcaactcactccccactgtcccattactggcccctcataaaggcttcctgatttatcactgcagtaggactgaactcttccaccaggaggtttgctccattatgctccattactctggcctcatttgaaagcagcctctggggctttatccatgccaatcaggaggtcttggtggaaagagctccacgtgcccctgagataacagaatgctagcttcccacagctcagacccactgagaatcctgaagaaggagcccagcatgagttcattctccttcccaagagaaaagagagcagaaagaaagaaaaggaagcagcattctttctcatccctcgagatggtgaagctccttttcatttgcttctgagatctgcaaatcaggtggcaattttagctctttttgccccccgcttcttgctagagtatcagaaaggcactaaggccagcagcctctttcttcatcagcaattagatctatggctaggatctgtctacctggcactgacctggggtaacctcagttccaatctctgcagctttccagaaatgaggcttcagtgtggagaaagatttttgtttcaaataaaggcttttcttacgctcaaaagcaatgtaccctggaaattgttgctgggaggacaggaatgcaggatgcaggccctcagctgtgaagtcctcccctccgttccccgttaccaagcacctctacttcctccctaagacctgaggaaacgctaaaagcaggcacaagcagtacacagcaaatccccacatttcacggcatatgcgccttcccagatgactgcatggatacactccataacacattgttaaagtgataattagcgatagacttgttatgaatattccaaatacagtttctctctacaacagttgatggagacaaaggacatcacacgaaatgtaagaagtaacagagggatttttgtgcatatatttttaaaaggtcctgggaaaatagcataaatcagaagttgatttcaacaaattaaacatttcaggacccatttccaatgaaagatgcatgggcatcagtatttcctccgcaatgcttagggaacacgccatcctcccacaaactccagtaaagaatgtgaaacccaattccagaagccactcttctgttgccctgtttcacagcagctaggagtgctaaagacgggtagtttaagaaaaaaaaaaaacagaggaaatgctgaggaataaggaagaaagtaactacagccaacgtgactcaccctttaaaagtaaaagagaaaaggcttctattcatgtttaacatttctccctctaaatgaaatttctggaggccccaactctgcccccacacctttacacacattctgattttttttattatactttaagttttagggtacatgtgcacaatgtgcaggttagttacatatgtatacatgtgccatgttggtgtgctgcacccagtaactcgtcatttaacattaggtatgtctccaaatgctatccctcccccctccgtgtgtggggcctccacaacaggccccagtgtgtgatgttccccttcctgtgtccatgtgttctcattgttcaattccctgatttttaaattcacagtgattttgctccacatgggacaatgttgataccaatgacacactccctcctctcattgcctgcttcaccagggtggatgaaagacttcaggcagccaaactgaggatagtaaagaggggagggagcctctgacaccaaggaacaaaagaaggagacccagccccaccaagtccacctccactgcaaactgagaatcagttcagccaaggggcatggaaaacaacaaccccttcagggctgaaagggagcagcacactaaactaacaaggagaagaacgcaatgaacagtgctgctgcatctcctctgtgaacatcagggattctggacttactcagatagaatgttctattttaaggatgaacctgagctcttctagtccaagagggagacacaagtagcaacacacgttatcatgcacacagagtcctctgcaggcaaaggcgcccttctcctccccagcagtatcgctagacgtcatccgatgccgcttcttaccttaactgctcgcagggtcacagggcttgaaaaccacagtgttggggacagccctagagccatttaagtacacccctttcattttctaagtggggaaactacaaaccatagaggctgaataatgtgctcaattcaaaaggcttgaaaacaagtgccaaggttggtgtaaaatctaggaccttcaagtctcaatcttagtccaccctctacaacaatgttccccgcttttccccttattcagactaaactaacatccaaagcatagaattatcttgaaggagtaacattaaacatcaggatcaaaatataaagaaaggaaaatctaacatctcatatagaataatctcagcactatacctagaacacaccagctgacctgggcttctttgggtcctgagggaggccagccaggggcagaggtcaccaggaacagcctggagaggggagaagagggccgctggaggccttcagggctcaagcttctgccacagggcctttgcactgcctcttccctctgtgggagctccatccctgggcatccacagggctcactccctcacctccttcgcatctatgctcataggccccattctctatgtagcctcccctgacaactcacttgaaaatttcccttgatagtccccatctcttgcaccctacttaagtttttccatggtatttatcactttctaagagactacaatatgtttattctctaccaccttccattttaaataatatccatgaggacaaagagttttggttcactcctctatctcctgggtctacaatagtgtctgacacataataggtgctcagtaaataaatactagtagaatggataaatgagtgctcattccttcactgtctccatcagcaacaaccacctacacacctcctatacacacacacacacgcacacacacacacacacacacacacacacacacacacacgcctctttctgcccttttctctcttcttcacctataccccaggcctgccactaggaacaacagggatagtttaggttaaacttagaacattcagtaataatattgccaagccttccattaaaaactcatgttttatatacatatatggttttataggcacaaaaactctagaaggatacacattaaactgatatcactaggtgtcccagggaactagatggctgggcatgtaaacttttcactctatatgcttttatactatttgaattttgaactatatgaatgtaattacctgtcaagtatgtttaattaaaaataaaattggaggctgggtatggtggctcatacctgtaatcccagcactttgggaggccgaggcaggtggatcacctgaggtcaggagttcaagaccagcctggccaacatggtgaaaccccatctctatgaaaaatacaaaaattagccaggcatggtggttggtgcctgtagtcccaactactctggaggctgaggcaggagaattgcttgaacccgggagacagttgcagtgagccaagattgcgccgctgcattccagcctgggcaacagagtgagactccatctcaaaaagaaataataaataaaaagtaaactggaaaaaccaacgcacgaataacattcattcctcagctctcgtcctcacatcatcttaatacaaatttttcagggtgacggtcactagaatgctgtcagccctggattagatagtgaaatatggtaacattctccttttctctcatcccccaattttctgaaatgtgcatgttacttttacaatgaaatatttgaaaaagtttccattgtgcagaaggatatgaattaatgcaaatttccctacatacataaaacatggagactttgtttcaactcatgaatccatttacctttcattctgttaactcctgttggatttttcatttaatagatttcagaggaagttgtctaagatggtgccaggtcaccagaggtgccaatgcaggacacaggcaatgccgtcaaggttgtatccggtgaggatgaccacaagcaagccaggctcatagcctaaaggatacacctgaacgtgttcgctgtgaggaatgggccagaggattatgtgatgtttcatattttttccttgggactttcagatttttccaagttttctgccctgagatgcattactgaacttctgtttttcctcttactacactgtgaagtaaatgtgtgtgatgagtcactggcctttgccaggctgtgatcttcccaagaatgaagtccctatttaattcatctttgtcttctcagcctcttgcctggtgccttgcaacagcggctcctccatagatgggtaatgaaagaatgaacaaatgactgtttctcagcatccaatgagcactcatgggatatagccacatactaaccccaaagagacaacaccactccctcattcactgcctgctcacctcagtcatcattcatgggtattccctgttccaggcaaggcaacggaagccagagccacccaagtgtggctatataaaggcatccaggaaagggcatatgtggccttcccagcaacctagtctctcatgcatttgggttctgagcagttaatgctggctccatactttgacatctttgtaacttttgcaaattttcttttgattcttttctggggattcatcttaaggaaataattagtcataggaagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttctctcacacatccagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatgacatgaacttggcaacttctgagaacaggaatgtctagtggtgcttctagcctaaagtgacccagtttcagataagacagtttaatccagaactcagagggagaaaagattaatattttctcctagggaaggatacccagagctaccacagctgaaatgggaataacatgcttaaaggtggatatgagatggccaaagtcccatgaggaatggcctccaggtatgatgatgaaatccagtgcaggagggaaggtctcttctcatagtatccaattgcaaaactggtcaaaattcaaccattttctcagggttattctaaaagctgttggacttgtactgcttctttggcttctctggctcttgttccagcttttgcagttacaaaatgagaaagacctcgctgtgctgtcctccattcagtgggttctggatggattgccagatgatgtgaagggctcttggtcatggctggtacctgcaaacacggagagtgcttatcaccattggactctactgtgccatttccatcatgtcaatcatggatagacatgagataaggaggatggaatcggcagtgggcaggacacaataggaagcgagggaggggagagggcaacagggtggaagggtagagagaattgcaggaagaaggagggacccaggaatggcccaacatcctcagagatgaaagattacagaaagagggcagaaggcgagagcagagaggccatgccagcttgggctggagcagtcagattcctcaccacacccttgtccctgctgtgcccatctgctgccctttctttgccttctggccctgtaggagccatcccagccccacatcccaagccctacctgtgactacccctcccctaagccctaccagagaaatgaacttacttctacccttcgtgggccgcatgcctccagctccagctcttcttggggctccagagtgtgccagtttcccttcaagcaccagtgtcctcaacctctggcatggtattggaatctgtgccttcagaacctcctttcttcccattcttcaggacgtttgtccctcgactggacaagatccagcaggagtgggcaacacaggaacaaatccgagacaccagactgagagggacaggaaggggaaacacggggcagtcctgggtgatctggaccatctggtcacctcattctagttcacgagtggacatttagataagggaaaccaaactgaatcagaactctaaactcagtgtgcagcagggtcaccagattgcttattctatggcacctgagacctttcatcaccactgatcttcacgacagatgcacgcagatatatctaccaaggacttagaaacccaagacagtttcatactttaaaaatgtgtggaaactaaccatgcacaaacttctccaattacatcagtctccccagaagcacatccaacagcactctgtcacaacttctggaagcagcctgcctccttgctaacccctcctccatgcagatgctcacctagaggagtggatgggacataataccaaggaggagagtgtgggtccagtcctagcacaggccaggaacattttctgctttagagtcacaggactgttcaccaagccaagctgaataaacatcttattgcaatatttgcacagacatgcaactacttgctgtgaccatgacagtgactggaatgtaaggatccatcagtggtagacccaaatcttttttttttttttttccaagtcttgccctgtcgcccaggctggagtgcaatggcgcaatctcggctcactgcaacctctgcctcctgggttcaagcaattctcctgcctcaccctcccgagtatctgggactacaggcatgcaccaccatgcccagctaatttttgtatttttagtagacatggggtttcaccatgttggccaggctggtctcaaactcctgaccttgggatccacccaccttggcctcctaaagtgctgggattacaggcatgagacaccacgcctggccggtagacccaaatcttaaagcacatactctactctagtggttcctaaactttagcatgcatcagaatcatttgtagactttgttaaaacacagagttttggttacactcctacggttttttaatcagtaggtctggggtggaggctgacagctagagtttctaacaagttcccaagcccagctattgctggtccagagaccacactttgagaaccactggtctaccaccaacagtgttcaatagtatcacctgtcttatatcaaaggaaccactaatgactcactcgcactcagccctgtaacctcatccaaagcagaggcacagaaaaggccaccacacacacaaagaaaaactgtttacaaaatgtttttattttaaggttaagaataaaaggagccttagggttcatataatctaactacctcacttaatataatattaattaaactaagcttagagagggtaacttgcacacagaaacaatgaaacaatcaatagaacccaaaccaggaaccccagcagcactactctcaaaatcgcaaacgtggagtcctagaaaatctcctaatttttgtcgtcattagagtcacaaggctcaagagtctgcaactggcaaattagggcttccccttctggtcctccatgccgaagcactcaggccatgccatggtcatttcttagtaaggctatgatggaagcaattcttggttccctccaagttcaactgtgagtccactgcctagaactcagaactggttttctcagaaatcccatagcacacgtggagggttcctgggagaactcttcctactaggcaccacattgttgaactgcagtgatgatagcccacaggatctaaccatcatgaagaatataatttcctaaaattccattctgagtttcaacttggacctgtgctggtccctcttcctggaaaactgctgccccagttttctcatgtcaggctccttctgtatgtttcctcttgcagagtatctcctgatcatctacccaagtagttctcactcccctcctgccagttacactgcatctcatcagccttctctacactccttatagccctagaactatataaaacatttgttcatcatctacttgctcattaccccctgaaagtaggatgtgagcttcgagagggcaggaactttacctttctgtctaccactataaccgcagcacctagaacagtgcttgggacacagcagattctctatacatatctgtctaatgaacaaatgaatgtacagaagaatgatgagagagcaccttcttcttcttcttttttttttttttttttttttttttttttttgagacagagtcttgctctgttgccaggctggcgtgtagtggcatgatgttggctcactgcaacatctgcctcctggattcaagcaattctcctgcctcagactcccaagtagctgggtctacaggcacgtgccaccacacctggctaatttttgtatttttagtagagacaaggtttcaccatgttagccaggatggtctcaatctcttgacctcgtgatctgccagcctcggcctcccaaagtgctgggattacaggcgtgaaccatcatgtccagatgagagcaccttctttcaacgtggtttccaaagttggaatttgagactttccttcctgtttctctcattttcaatagtaggagttagactactgagctttaatagaacgtggaaggagaaaaacgtgcccttaggctggtgttctcaatgacaggacagagaagaggaagttgcagggattgggggtggtgtcgatttacttctcagctctggtgtcctttcgcacagaaagcatgctggtgagtcaggtcttcctggatacagggcttgggaggcaatgaggtgtactggaatgagatgtttttgagaccaaagagttgggttcaaaccctcaaaaagtcatgtaaatctctctgagcctcatggggctggtagaaaatacccaagggatagggtgtttgtgaggatcaaggaagttaacatatgtggacactctctgtaaatagtaaaataatataagttgctattaaatgattattgataagaccacataggctctggagagatccaaataggtgaaatttctcggcatgcatctccattcagtcttgctgttttgccttccttagttctaccagcactctcagaccccaggctgctgcgtgggagccccggctcaagagcagaagccctaaggtgctggcatgggctcctcagagccccgtggggctgccagcagccacagcacagccatgagcagggcagccaacaggaagcccaggagaagaccactgtgagaggccacagagggacacagggacaccgtcatcggccctgagccaggggcaggtgtaagaaacaagccggaagccctcacttttggcccaaatgctttggataggccagaatcccagagacaggaatatcagagaagccagcttccctcttatgaccaggccctggcttcttcatgtccttagggtgggttctacactccactcccaaaagcagggcctatacttcttcccttgccaagaaggtggggtggatggtattgggatctttggatggattcccaagattggagaaggtctcctttctcagtcttcatgggctgcactgccaatttctcattgaccaaactttaatgttccaggcaacgaggctcttggctataaggtgtcctcatgttacagaaatcacctcctctgacccagttactcccaaactgtttccactcttccttaagtgataaccttaatgacaagtctcatgcaaacagtaatttcttatcctttcttccaagagttcagttcactccagcaactggctactaactacttacagctgagcacagatttcacgcagaactgtgtaaagttgtccttgggaagacaaacacagcagccagttcctgccaccaagcagcacacagtctgggtgggaacagagacttcacgtccccaccacgaatggctgtgttttagagttcattacctgaaaagaaacagggtgggaggcatgtggggaataaagtgagcaggctggaggaggtcttcttcaagaaaacagagactggcccagctctcttctggctccaaaatgctgtgtttattgggttgtctggatcagaggcaaattcttggatttctgacaatgttgctatgatgtaatgagggctagaatcttcttgaatcaggaaagtttcagggaggttctattagtctgttctcacacggctataaggacatactgagactgggtgatttataaaggaaagaggtttaattgactcgtagttctgcatggctggggaggcctcaggacatttacaatcatggtgaaaggtgaaggggaagcaaggcaccctcttcacaaggtggcaggaaggagaatgaaagcaggaggaactaccaaacaattataaaaccatcagatatttcgagaactcactatcatgagaacagcatgggggaaactgcccccacgattcaatcacctccacctgctctctcctttgacatgtggggattatggggattacaattcaagtgagattttgggtggggacacaggcaaaccatatcagaggtgttatatagtaaggagcttaaaaaacagaaggatttcaacgtgtagaaagggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctagagaagcctgtctgtaaatgatgatgaatgtgtgagctcaccaagggagaaggccagaggagctcacacatcgaggagctggctttcaagggatggggaaagaaaggcaccagagaagcagagcgaagacgtggaaaccatagagccttactaagtgtgttcactcacccggctgtacctagggccacctgttgtcctcttggatggaggcagatcggctttctctctccctctctctctccctctctctgtcccacctcctctctctctctctctctcagttctgggctgggacagggaagaacagcaggactctattacttcaggcaaattttgacagatgggccaggacctgcatacagggccacccagcaggcgctggggaagggagcctgctaaggggctgactgcagagccaggcccaggtctgaagggccacgggtgcctggtttcaggttggaaagggtttcaagttgggcagggttggcaatggagcatcccactgaaaacagaagagcctcacccccaccccactgactcctgttcgctcacccctctgagcttctgcccatgccgatccctgtgtctggagcactgctcagggctccctcttggcatattcttgctgcacttttttttttttttttttttttatactctaagttttagggtacatgtgcacattgtgcaggttagttacatatgtatacatgtgccatgctggtgcgctgcacccactaatgtgtcatctagcattaggtatatctcccaatgttatccctcccccctcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaaccgtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttcttgctgcacttttaaaacctgcttccaaactcaccttctccatgaattccctaactcttgaagtcaaaaatcgatcttttcctcccctatacactattctcacaacacttttcatacacaaaaatcagatatggctctatctcccccactggaccatagaactcctcagattagaaacggcactagggtcacaaattcaaatgctcacagagccaggcagataacataaatgggtgaagctgctggtttaggtgacatgggtggtaattgtcttggtgatggccagacaataggagtcactggaagctgtgatgaatcagaggggctggaatgattgattgattgagacagagtcttgctctgtcatacaggctggagtgcagtgatgcaatctcagctcactgcaacctttgcctctcgggttcaagtgatcctcctgcctcaccctcccaagtagctgggactacaggtgcatgccaccaaaggggcctgctgcccctcctgcccatatggagaataccagagcatgggaatgtgacctgtattaccagaactgcaattttcagggagaggccaggtatctgcattcttatatgaaattaccccatctttatgtgtcagcagcaaatccaaatttaagacaccatgttgcaagccaaataaaatgcatctgcagccagatgcaatgaaagcttgttgattgaaaagcaaatgaacaaatgaatgaaggaatagaaaagaaggagcagatgggtgggagggggaaacaggatgggtgcccaagtgtcaagatgccaagcggtgggctgggcacgctcaaggtgaccccgttgccaagctgtcagtgtgaacatcagcacggtcttgcttgttggctaaggggaagagaaaagcctatggccctgtgaacttagcaaccagcttctccaaaaacattacaatcagaagctcttgttgcagccaaaacacaggtgcagaaaacaagcgggcgttcgcacatgcacgtgcacaaggtgtgcagaagttgaaggctcagcatgccacaaattccgcactccctccaagcacaccttatgcctcatgttacagatgtcttgagggaggaagggagggacaatttagcaaattgggaggtgcagcaggggaaaaggagtcatccagccagaattctccccatctctacccagaaactccctctccttgctttgttgacggcgctgaagcttgggggaggcataagtgagcctggtgtgggactgaccctcagcctccaggaacactatcggcaggaacacagcccgtgtgggatgcctggggttgcaaaagaaaagttatttcaggttcaactgagttataatttattttttctaactgatcattactgctgcggctctataaataaccacctagggagtctgcttttctgctcccaaatcctcaaaaagcattgccaggttctctgtggtttctggcctgccaagcacacagcacatttcttttctgtgcagcccttcagggaatccttctgcagtgcatgccaaggaatctgctgagttctgcccaactcagtcctccccttcctgatccaattcctctcctccaaactggccatccagccctcctcccccattccacaagaggcccctctccctggacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccaccccaggaagggtggctgtggtttacatgaaatcaatttaagtgatttaaagaagaatgtatttcaagtacaactcagtttaaccaagtatagaaaaaaaaaaatcatgttcctgatgatgttctaaaggatgtacgtttaggccctttctaaataacatggggttttctccttaaacagaggaactagacgggaactaatattcatcaagacccactccacaccaagcaattttgtttcattttcacaacatgatgcctatgaggtatgcatcctcatgcccatcttgtagatgggagtcctgagaaaaggacttgctcaaagtcatgcagaaggaaagaggtaggggtgagactcaagcccaagtttttcccctgctacctcctattacctctctaagctagaagactggagtttcaatgtatgtttatttttctaactttcagattacttttgcagctcagaaagcaaggacaacctggatatttcaccacagttccttaacagccatataactctttggagttagcctctccaactagttaactgtgaaatctcaatcaatcaatcaatctctctctctctctctctcaccatttattacgacaatgaccataaaggctatggtcattcaggttgctttaatggtctaaaaatgagagcttatgtatttttgaatagttttaaaaatgatcattcctaacatttacaaaataatggaaaacataagttttacccagtaatcaatgctccacggaaggttaggtggccctgcagatgctaccacagcactctgctctgttgggacaccttttccaccatattggaatggactgtttccttgtctgactctccttctaggccggtgatccccaaagctttttggtcatatgccctaacaataaacatttgagtgtacctgcctatgtgcacatttgtttatttataaattatattcatgccctgtcattcacaaaaatgggaaaaaggatgagatgtgtgtgggtcatcttcctatgtgtctatctacttctcaatcataatttcttcctgccccacaatggaccatctcaccttccatggtctccaacaccgacatcccactttggagaccactctcctaggatatgtgctcatcatccctcatttattcatttcccactgtctccagtaacacctaccctatgctgggtactatgctaggtgctggggatagtgggtgaaccacatggacaaggatcatgttttccatagagcttacaatccagcgggtgaaacagtgtcagataatgtcagagagagaaaacagccacaagaaagtaaaacaagatgatgtgatgttaagtgatggagaatgtctacaggggtaagagggaagtcacgatggaccagaccagcagctcagcaaaggcctctgtgacctgcatgaggagggggtctagtgggagagggggtgcctgggcagacagaatgtcaagtgcaaagcttccgaggcaggaaagaaggccattgtggctggattataatacatcagtaagaagagaggctggagaagctggagaggttggcagctcaggctggagagtcctgaccccactgcttactggctgggtggccttgggtattaatgctatatgctgcccagggttattaaaggaattatgtaaaggattgaaagagtaaatctatgaaacatcaacatcagttagaagaatgcccagcacacagttggcatcaacaaatgactgcccctagggtctgtttacttatttatcattagtctcccctgtggcatggaagctgggcctggccagttttctaccctgccgaaccagagtagctggcaccatgcccagcctatagaaagaactcaatgaaaatttggtaaatgaatgggttttaaaaatgggtaatggctaaggaaaatcagaatttggctaaatattaaaaaatagattttcgtaaacaattttttctaattataaaagtaatgtcatgtcttcaatattttaaacaaaaatggggtcatattctacataccgcttagtacctattttccactccacatgtctgttacaagaggcaggagaatgtaagggtagggatgtgggctctggagacagattgcctggattcacatcctacctccaccactggccacctagagcatctctctgaagttaccaagccaaaggacatttgggatttttaaggctttttaacacatattgccaaatagtctttaagaaataggtgtgagcccatctcctcaaaccttcatctacgctgactgctaacctttagacaatctttgccaatttgttaggggaaagaacaacctttcattgttctaatttgcctttctttaattaccagggatgactaacagtttttcatttgccttgttcctcttgcgaattgcctgttcatgtttaaaaaggaagcccgttttcataattagatgcagcagagtaggtggcctcaaagtgaactccctaccgctgggaagggttgagcagggccaggtggttgcccatcagggaactgggcatctctgtgccttgtggacagcagaactggatgagctctgaagtcctttattacactgggatcatttcactcttgtccagaccagcaaaggtagcaggcaaacctcaaagaaaagatggcttgcggatcaacaactggattctgaagacctccaccaggatttcccaaggtggatttgatgcctaaacatctctcataagcttctgcataaagacaccccagttatatcggagagaagagtcaaatcgacatggttatgcctctagtagctacagcatgccacagtgggggaattccttaaatctcccccttgacaagatggaaaaccttcgtggtcatagatcaaatcctaccacaacaaacatgttcataatcaaggtcagcatagcacaaagactcctaaggtggggccagtggtctgtttatctcaagctataacttttttccctgctttgcatttggctttggtacaagaatttgacataaacaccctcctaaccccactcccctacaggtatttacatagcaattttctcctgagctggtcaaaaccctgctaggacttggagaattccattgtgtttgtagtaagcagacacctggagccagatagctcttagagaataaactattcttggattggaaagggatctgaatgtatctgacgccctccttttgcaaaaattttgcagtgttttcagaggaccttctacattttcactaaggggatatttccccctaatatctccaccattgccattgttggagtttcctgctgggtctggcccccacaggtataatgccagctggaaacagaacactcacatctcttaaattactccactaacgaagaagtcacacgtggaattagaattctggctaattttcctgtgggcacaccttaagcacacaaacctgaaagcagcagagcagcgaaactggcagccaaaataaagcaaaaagaagaacatcttccaggagggaggtggaatcagattgaggcaaagccaggactaggttcttggcaacgtgattaaaatcccgaactacgagggaggagaggccttgctgccagcccctcagcacactcgagccagggcactggaggtgggtggtggttaaaagctgtgtgccattcacagcctatagcactgcctgtgtccgtcagtatgggcagaatggctaatgactccaaataaaactcctacaccatgctccatctggggaccatgttatagctgaatacacaaagtcactttgtagcttgcccgataagtccactttaattcctccaaaataattcatggaggcctgtgagcacactgcaccaggccaagcactagggttataaaaaagaaatgaaaaaagaaaaacctagttgctctactctaagggcttatgatttaaccaaggagatgagattcacaatggtagctggcaatacggtaaatcaaggcacaaagaatccaggagtgtgttctgctagaggcccaagagggcagctggcattttcaggaggatgcaggtcagcctttatgggaaaatggattgagtttaccttgaagggtggggaaattttaggcaggtggctaagaagtgagctggcctctggggatgtggggagactgtgagcgccgcatgagacaggctctgcatcctgcacatgctgcctgcatttccagccctgggaggaggatttgtgcaagggaggcagagatgagagcgttgataggaaggaaggaggccagatttcagagaggtctgaatcccacacagagaagcttgggctttctccaataagctgcagggagcagttggagacttgtgaacagcagattaacataattaaataaaaacttcaagactttagctttttgtggggatgcagactagacgagaggtgatgagaacattagaaagcttttacagtgtagaccaggctggccacggtgttggcaacgggagagaaagaaatagatctggaagataccacaaagcaaatatctaaagggcttggaaacaaatttggccggggggcggatgaaggatgagtcaggggcagttctgaattttaaaacttgggggatgtgaggtggaggtggcatcgtcagacataaagacacaggttcgagcagctttacaagaacttaaaaaggccagaccacccaaaggtggcactgactggaagcacgaggctacggacaatgcttcctcatttcaaaggggagttaacaagttaagtgaagttttatccaccaatgaaatggctgtctgtccaaacaaataagcaacaagtgtgggctctgcactcctctccacctctcttgctccttccgttgatgctcccctaacatttatctgaccataagctaagagcagtcatgagaacaagatagaaatcctcagaaatccagaactctaatccttccttctgctgaaatactgtagggcttagttattttcacacttatgcatatgcttcagtgtgtaagaactgagtcattgttttcttttctcctcccctctcccctctctttccctcctctttgccacccagcacctcctctgcctccacccccaagccactgcaaacatcctggcatgcatctctccccatccatttctgcatggctgtcaacatttcccattccctccaagcttgcctcctgcctcctatttctttagacacactgggagtctaagaaatgaactacagattcaacaggactgtggaccacagatcttgacaaagacaggcagcttgttgtgaaaagagaattggagggcaggtcagagacttaggttttaggagtcaggcaagggaatcagataaagatccctgaaaacaagggatatcatcactgcccagctttactgacgtagagacaagttttctcacttggcagatatagacggaagataagcaggttccctttcagatggtaaccccaagtgcagtggctcacagctgcagttattctgaatggcagcgggagggaaggaaacaatgaatgcacacacacacaagagcaatgcttaaggtgaaatggacttgaacagtctcaaatgcacacctcctccagttcctggaaggcaaggatgagtcaaacagaagttgaatttcacaggcgttcctcctccactgtcacatacgttcccagacgcagagtcatctgtgcacatgtcacccagcatcgactgctaccagcaactgcctcctgggaagttaagctgcagggtcagatctgcttctgctggggagctgaaagtaaactgcgtaaggtgggggtgatcccagtaatgtgagggcaggaaaaagcagagaacgctggaaaaggatggcaggaattaacatggctctgaagagaggagccaaggatcacctgatctgtagagcctggaatctgcagttatttctagtttcctagacaaccctgactaaactaggaagacatctgaactccggctcaaaaataatataggttcttggaatgggacaaaagaagaaaggaaaggggaggtgataccatgtgccagttcagggagtggggaccagaccttcagagaaaggaaggtcttcccaaatggaagctgaaatcccagtgggcattatgctttctgtacttttgcatttgtagccaagagcatgattctaattctggttctccagcggaggtgcgggcagcacatgtgcatgagttcgtcaaaattgatctaacggcacacataagatctgtacatttcactgtatgtaaattagatcctagtaattctacctctctcaattagttggttgtgtgaccttggacaagtcatttaaatttttgtagtccaggattctccatctgtcaagctgaagctaagaagctggcctctaagtttctccctggctctaaaatttacgattgtgagagctgattattgcaggaaatgagcaaatacatccagattaagaagggccgcaactattgatagaagctaagaagaatttctgaatgggattagccatctgcagaaaattccccctaaatcatccatcctggaatcagacgtggagagaggtgaagattccatcctctgcaccaaaaggaagtggcagcccctcctggctctgcattttcccctccttcccatccgctctcccctacagactctctaaattcttccactggagattccccaagggctcaggattgggacaggccttttcttcccttccttccaaatttcctttgggtttatagcaccctggtcgggttcacaggaagggaaaggagagggaagaaaccattcacatttgggtgtgcgtagcaagcagagagctggagggttacagaaacttagaggaggtcagagccagacaatcatctccccatcctatgtcttatggataagaaaatgaagatgcagaaaactagtgtgacttctcaccatttctaaagccccggaaagaacagatcaaggaggcagctgtggccatcttcaggctggttctttcacatagagatgctcctacttactccataaatagtttgtcatgggcaactttcagacagaggagctggaactaccctaaccgggcactggaacatgtgtaagtagaccacctggctcacctgtttctcttctcagaggggctctgagtcatgaggagaacctctggatatgcagaatggataaactgcttctgtcaggatggaaaggaattcacagatgtcttgccagcagctaaccagtgacacagctgaatggtagcaggcccatggaaacactctggataagaaagactatcaaaggagcatcaggtccagattgcaaattgctttagcagctaacataggcataaagacagaacgacccactctaatccaagggggttacgcttcagcgctggctgcctctgactctcacccttgacccagcccattcatcagtatgttgataagcagattctcttcacagagctccttaatctggtttcccagggaggtcttgcagagattaatgagagcactgtgcttcctgccagtttttgaggctgggacagttaaacagcaagggtgaaggagcttgtcataaagtacacaaaccatcccatcattggacttgaccccattaggtggttaactcaaacatcttctcaatgtagacacttggatctattttttttattcactctctccttggtagccagcaaaattaaagcccttcctcatatcatcgttcacgccatcttttataatagtcacagccacaacagcagctggggctaaacaaagattaggagcaataaggatcagatgggacagacaggagatctggtcctaccaaggggcatcaccaatgagctggacccactgtgcagcccacctgtcaaatgccatttgccacctctggcggtgatagcaggggcagctggggctgaatccatgaatcctgaggtctcacagaagtacagccacccctgtcatctagcccctcccctcagaatatgctctggggagctgtcacatcccacactgcaggctgatggaagacacagacacactcttgggtcctggcattatcgctgtttcctctggttacctttaaagaagggcgtctctgagtgctgggtcctccactggaaataatgtggggaaactggatgagctctgcagagatgagaattattttgaagcaaagtaagaaatgaccagggaactctagattggaatacagcttgtgaattcctaggtaggtgtagactcaagagtttataggaacttatatttgctgttattttttaaaagtcttaaaagttaaaatttacagcaatagcaagaaggaggacaaagtgcaacagctttaactatgagctaataccaaggttaacactatctgtccattacacgtagctttgggatttggcaaaaaggaaaaaaaaccacataacacggagctttgagctcataaataggtcccaaagacttgacaaataaactaacaaggcttttatggtagaagggagcatcgaaatctgaggccttctgtgccttctctccccgctgctgtgatggcagctggcaactgggccctactgtccattaacaaaacagagagacggataactatccagccgaggccagcttcctcacaccaggcagatccacagtggactctcaggaatcttcagcaccctttacaccagcagtggtcaaagtggggggtgcagctgccttgggactgagagatggggatggacacatctgcagggaggggtcaggctctagcccctttccccaggccaccactcctcagaggctggtcctccaccccagcttcagggacaggggatgcatggtggaaaccactgcagctgctgcattagcaaccttcaagagccaaagattctcttctctctagccagagagggaaggcaaacaggttagggtgacctgcagctcagggtcggccccaggccaggccactgcctgtactgactcctgggcctctatgcagtgcactccactttctagggcaggctgcttgccaaggattcacagtggacctggctgctccctgtgggactcactggatctggacccaggaccaagcctgcttgccaggagcagaaggtcaggttggtttaaaaaggtaacctctgtcctttcccagttccgttcctttctcttccccagctacctcctcctcttctccaaatcagccttctcttggctcagtttctgaccttgggtattttccccaaggaacacatccgaccatcaggcactcaaaggagcatgagcctagtcttttcctcaagcaaatcaccccggtacagtcagcagctgcagagcacagggagctcctggcatgctaaaggtcatttacagatcactgaaaaatctggacaagatgctaatgtcccagctcaatgcccatgtcctgacttaaaccttgactgtgtcttaaggacactcaacgtcaggatacctatgacagaaagagggacttctgagtatttcaggcataacaggcaaaacagacatctttaaagcttgcaaaatatatgattctgtcattcctctgcatcctcaccaccaccatgatggagagccagggccagtctttccaatcatcactcaagcttccagtggctattgggcactctccctcttagagaggggacactccagcaggaactccaggtagagagctgttctgcagtgggcatttctagctcagggccagcctccgagactctccaggagtggcatgaaatgaggtggatggggcttccttgtcctggccatcatgtgcctacagcaggcattggcaagctttttctataaagggccagaaagggttatggaccatcttctttgatgtttttattttacaactctttagaaatgtaagaatcatccttagtttgaggtgccatataaaaacaggcggcaggcaaatttggctcacaagcaggctgcagtttgcagaccccctcctagaggaagatgctgaggcctcaccaagcagcccctccccaccttccctctctagcctgactcctccagactcattccagctgcacgtggcacctgtactaggccgcaggatggccttcttgctgcaggcatttcaatgagaaaatatgctgcatggatcatgagtgattctgtctccctcgtgcttaaccttggaagcacaaggccctgctggcctcacctcaaggtctcacctgcccatactcatgcgaccttgtccaccatctctccactacgaggtgccatctggtaaatggcctaacttgggttcttcctcccacgcctcctgtgtaggttcagggcagggagaccaaggtaaatcctgtcagttctatctgaaggcagagcctggatccaatcacttcccacccctccaatgctatcacctagaacacagccacagcctcccatctggactccctgcttcgatctctgccctcccccctccccttccaaaagctcccagaggctttccatctcactcaaaataaaagccaatgtctctgagcagtgaaagccacccaccatggtcatccaggtcctatcactgacctgctgagccccaactggcccgcatggccacctggctggcctcagtgcctcctctttcccctagctgatactaactccagccacactggcctccttcctaccctgcttttcctcttagccatgaacaccatcagtagttatataatagtttgtgggggtttttttttttttggtcttgtttttctcactcaaatataagctctgtcaaatagagtctgacttcagtgttacactccagggcccagtgtcagccttgggtaggtgctctacaaatatacaaatatttggagaatgcatggggacaggatgccctgctgatgggtgagagatggtggcactgtcatgacactgtgtatcaatttgcacttggatacttttatgcaaataagtctcttgctcttaagtcccctcctcccccgccttagtagccagatgaaccgataagacactgaaaacagatacacccctggagacactagtctccaattttttgtttatattcaaccctaaagcaataacaacaaactcatattccaactgaactagtcaattatctcaggggaaaacaacaaacgattgctttatggtttagagcacacctgtgcgtggctctcccgcactcaccacaaccaccctcccatgagcacagcaaggaaagagaaagcatgggcttgctcagcagaggtctgggtttcaaatcctgacactgccatctataggtggtctgattctggacatggtaccaagtacactaggccttagctttaccatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctgtgtgtcacaagcaagggatcaaaaaagctaagagaattcacctgccctggatatcaactgcccttaagagatgcaaactaaaggtgactgccttcctttccccaagagacaaacggaaaccccactcagtgtgagaagagcacatgccatggaggccccagaccagtcagtgcccagtgaggagatgacagagcctgacgcagctacatctgagatcagatgccaaggacacagcaaagactgatgaagccatacgtgagacaccaaagtacgaaactcacattcaactcaaaggtttccatgtttgatgactgttatctccctgcacagtgtttttctttaaggagcacatgtgttctataatcctataaagtaaatttttgaaaaaaacaaaatgagaaacaaagggacacacagaaactcttgcaggtgacggatatgtgtattaccttgcctgtggtgacagcatcatgggtgtaagcatatgtcccaactcattagactgtacacattaaatctgtacagttttttaatatcaattataacctcaataaagttgaaaaaataaagaaaatttttgtagaacaaaagccttctcccattagctttcatcatgacattgaaatgtgttcctcttgaaacatattggcccctgacattataaaaatataaattattaaggaacaaatcttacaagtaacacgtttggaggacaaacaataaagagatggcctaaacaatgtctaaacagatttgaaacggagcagaatgtgagtgcgtctgactaaaagaggaggcttttctcaagtgtcagtcctgagacaaggaccctgggactgctgacatcccaaacatagtgcccctatgactccaagaagggaaggtgctgcaggggtgacggtccctccccaccccaccatcctcatctggctgatccctgctcatgcctcagaccttagctgaaatatcacttccccaaaaaaagccccccagcactagattgggtgactcattcactcattcactgagtcatccattcaacaagtgattactgaccccctagtatgagtcacattcgacttatcactctctcttttcaacgttgcaattaaataatcacacacacaatactgatttactgtctgtcaccctccctaaactgtcagttccaaaaggacagagattgtatctgatttgtcatttcattcccagcgcctgacacagtacgtgcaacatggtaggcatcctgtccatactggccgggtgaacgtacaaatgaatgaattaaagcatttgaaagctccattcatattctaaaattccaaaatgcaccctgctgtctactttacacagggataattgatgttacaatcaatatgacttttaaatttaacaaacgaaattgttttatttattaatctactagtaagtgaaaacaataagatgtaagacaacaggaagaaagttactctccctgagaggacagaacctgcaggtgttatcctgggactggcagaagcagcatagggtcatcgctgaggggagtgtggatagagtcaggctatctgggttagggtcttgacccctccactgaccagctatgtgactctgggcaagcaacttaacctctctgtcttccagttttcaaatctgtaaattgagaataagaatatcagcttcagataatttcattaacaagtaaatggattacgacacgtgaactgcttagaacagtgcctggcacgtgctaagtactcactaaatgtcagttgtttttattttctggaagaatgggaacaagatgggttaaaaccaaggacttggacatactgtcactaaattcacaaaccactcagaccaaatctccaagatttcctattacaaaatgaagtaattcaaaggcaggtggctggatgggttatctactccaacttccagacttactgctttacctatagaggtgatgatgccttatccatctgaaattaagggccaggtcaaacaaaccctcaaggtttctccaggactggagtctgggatttgattttatacaccccacagtgcccagcacaatgacgaacatgcatttaaagcttagaaaatgttcactgtgttaatttacaatgaataccatttaaagctaaaaaaaaaaaaacccctgcatattctaaagtatattatctagcatatgtgctagccccagaagaataaaatgcagaagtgaacaggagttgcttcatggaactgaaattaattatacacaattatctctgagatctttaaacagtaagtgaacaatgaaaatgtagattcagaattctcctggtaatgaataagatgatgaacatgtttccacagagggtgggatcaggttgatctgctgaaataaccagatagcaggataatttcactatctacgtgaaacattatccaagaatctgtgcgttactcgacaattaaatcagttcaaatgtcttatcaatgatttcatagaacaaccttcaatgagttaacaggaacccgtagataaaagacaagaatagggctacgtcaagaagctcaaaatcctcagctgctgataatgcaaaaccttggccacattgatgagcccaagaccaccagatctctttatactgagtcattttttaaagaaaacttttattttatatgttagttttccttataaaaataagttgtattgaggtataatttatatacagtaaaatgcaaccatttcaagtgaacagtgggttttgacaaatgtatatacccaagtaaccactaccctaatcaagatataaaaacttccataatgccagaaagttccctcatccttgataaaagaaaaacttcagccgaattaaatttaaaggagtttaattgagaaatgaatgactcgcaaatcaggcagcccccagaatcacagcaggttcacaaagactccaatgcagccatgtggtggaagaagatttacagacaaaagaaagggaaatgacatagtacagaaaacggaagtgaggtacagagtggcgggattggttacaagttggcatttgccttatttgaacacagtttgaacacttagcagtttataaatggttgaagtatggccacagggattggccaagacccagctattgttacaggcacatactcctaaatcttgtctacctattaagctaggttgcaattcatccacaagaactcaaatatagaagtacggagtccttctcaggccatatgcagtttgctttaacacactctttctcggttaatccctgctcttatctccctctatcccaccccaaggcaaccatagttttgacattccccctatagattagttttgcctattctaggatttcatgtaaatggaattgtacaatatatatatacttgttgatatctggcttctttcagtctaatgctttgaaaatccatgcatgtttttgcatgtgtcggtagtttgttcctttttattactgaataatatctatttgggtggactgcaagttgcttatccattccccagttgatgggtatttgggctgcttttagtcttggactgttttgaataaagctcttatgaacatccacgtacaagtcttccaccaacatatgtgttcacttctcttgagtaaatacctaggagtaaaatcactgggtcatatgctgtgcatgtttaactttctaggaaaatgccagatttatcctgaataacagaaatgatcaactgatttactattaaaggacttactggattttataaggaaaagaggaaacgagacgaaagaaaatgtagtgcatctgaaagcacatgggggctgctttgctgaaggggctggcaggcggcttcccaggcagggtctgctcaggactgctctagccagatgcctcccctggtgtttacttcacccacaggaaaatggccaccttcaccccaccttcagtggacgtgcagccccttcggtgctcctctcttcatctgccttcagaggtagtcctgattaacctgttgccagcagaattttctaggagagacaggacttgggggtaccactaggccccggggacatgcactcagctggcccaggcaccgataacctagcatgtccttttagaatttgggggatcccggcacccactgttctcagctttgggcctcagctaaggccaggacaagcatcatttaatgtcatgtcatataattagtatggaaactacaaaaacctatatgtttacaaaacaaccactgatctacattatttcagaggtaatgatacttttacatgagataacttcccaagacactaagctgaaattagataaatttaggttttctgtattctcgctgacttgtgtttttcacactggctttatcttggtttctgagggagaatcaattctctttaactctcttccagaatacctcactaccttcagaaaggaagaaggagggaaaaaaggacagagggaaggaggaggattagaattcctcatatcagagaatcccagagctttgaagctttaaagtgaattcaagagtgggattcaagagaccaaaccatggggtctaggggaaataaggaacccctctcccagaaggtggagaagcttctcaaagcaactggcccaggcagccttgtacttgcttcattctggggtcaggaagaagctgcaggccctccttcccaccctcgcttcccttctcctccacactgtcaactctgctccaggaaggggcagtatccccagtgtctgctgggccagcacagccatctctcacccacctgagttcataatgactcctgtgtagagcagacttcccttggcttcactgaaaccattccttcttgtcttagaaagcaatcagaaatatagttaactgccttaaagttcccttatcattgaaatgaactagatcacagaagtgcctatttgcattttttattcttattcactgggtttttaaaaggagccaagagaggggagaggaaatgcatttacttgctgggatttcacttgggatgttcatgttcgtctggaaagcaaaataaaggcatgaagattgcccactgatttcctttcatttggagaattctgcttgagttaggcttagctggctagcacataaacctgtcaagagaaaagtcttcctcttcctgggcctggtatgtctaccacctggggcttcagagacagtattctaggagattcacagtgtctaaggttcgaaatgtggacttcagcagcagggcagctgccaaacgctttcctgcccttgcagaaagccaccaccaaactcaccaccacctccctcaccgtggcctctctgtttcagtatctgagcagcgggtgaggaggactggattctagaagataaagagagactccacggtacagaaagtaagccctcaataggattctattagaaaacagctggaaggaactgtggagtcactcagtcccatggctgattttacagacaataagcaaacaaacaaacagaggccctgagggatttagttagcggtctccaagtgccagtccctgaggaaaggattctcctccccagctacctttcccttctccagtgtgtccacctcaggaaaagggcttgcatcctcccagctgctcacacacaacttgggctggccttggtgctggctctgtcctttctcccaccagatctgccttccgccctcgccacttgtctctgcccagggctcacttggaaggaccacatcaatgaacaaccttggcaggtcacagggagggatggagcgggggagagaacagcaaataggcttctgccctgcaagagagggagagccagaataccagcctggcttgggctgctcccgaaggtcctggctgctgcctgcaatgcagcgccttccttcagggctccagcaccatcccctgtcctcagcctttaaggctctactgctctcagccccagccctgcccttgaggctcccctgtaccctgtctttgtagatggtgcctgggaactgtcccgcttggagagtgctgtttgctaggatacacactgactcccatggctcccctccagctccccatccatcctgctcctggccacggcctctggcctgaagggctgcaaaacagccttccaactgggttcctggcttcccttctggcccctcttcatctgctgtccccagcagcatacagagctatcccatgaaatataagtcagaccatgtcatgccctggcttaaaacctctcaatggtttcctctggcatctccagtaaaaatcagaactccttgctgacttttgagagctgctctagacagggctgctctctgcagcctcctcttgtgccccgagcttcaggacactccagcagctgtggggcctcctttcccttactcatgaccccaggctctgccctgtctctgggcctcacacatgctgtccctgtgcctggcaggtgccccgtcactggtacaggctgtccccacccctctaggagagccttgccttagcagggtacatgccctgcaccttcttctctccacgaatttttattctctatccctggactgtgctcatttctttccaaacacctaacaaatttgtaattatgtgattttttgtttactttttaaatgactctctcccccaccgggatgcaagttccacatgggtacgaactaggtctgtcttgttctccacctgacatacaacagctactctagtcacatctacaaaacagcaactgggtttgggttcctataaagtggacaactctcctttctggggaaggattgcttcataatctgagattatgttccttctactttgttggggagagtgttaagttttttttttttttcttttatgaaaggatagtaagaataaggggtattcatcaaaaatttttaaatgataacctgatataattctccaaaatgtttttaaaatttttgagtctatgatatcccagattaagcaatgttttgggagtcacagtgttgggtcctagagaggcaaagagataggtgaagatagtgacagagaagagaccggctttgcagtcagactgcagggcctgggttcaagtcccaactctgctgcttggtagctgtcaaactctgagcgagttgcttaaactctctgtgccttagtttcctcatctgtaaaataaagataataatagaacctgtttcagaggactttataagaattaagtgaattaatacttgtaaagttaataaaacagtgcctggcctatagacaatgcttgacaaacattactgctatcattattatctattattattattattgctattgttattattactaaacccaggtctcctaaatccccaaccaggactcttttccctttaaaatgttatctcccagcattgtctctttaaatgttatctggccactcttaaatgtaagactgaaattcagcacttggaaaactatcccactccagccaagcacattttttgaatagctaaacactaaccctgataaaatgtatccatttaggatagaaatgtttctacaatatgttacatcttgtctactttctaactgggttttttgagatgagtatcattacagaaattatctgctgtgcagcctggaaacagcaaaaggaaaactcagcacgttctacagacgtgggttcaaagccctgctctgtcctccctccaagccctaaacccctcctgagtttcagtttccttactgaagaagtgggaaggccatgtgcattgagaggttactgtggttttgagtccagtgaatacacacactgctaaatcctaaaactcttctttcttttttggttaataatattaaactcatccaggagaataccttaatttaagactccaggcagaattctcctttccccaagctctgccaacacccaaacccctccccagaagacagcctggttcacacaacagaggaacagacccctcacgactctgcagggggaattcctttctgggagagaacacatgtccaatagggccagtccccactcaggctgctgctgtcactcagccagaaggcaggacaggcttttgaagctgtgatatttctgagtttggttttggacaaaaacaccattcttcctcatagcctttcacaccctgattcaagcaattttaactgaattctatttcccttcaatagaaggctatttgaagatacaaaaaccatatttgtgaatgaattctaggattgtatttgcagagtcactcctgttggatttcgtgctctataccaagtgtatttctacctctgggcctcagaaccatttctcacaccccccaacaatatctcatgccctcatatcccaaatatgcaattacctatcagttgtgaaaggtaaaaataaaattcatatgggtttcataggtcaatggttcatgttaaaggagacccatattaaataatattattaagtagatatttataaggctaagaataaaaggtggggaaatgggtgggattcatcttatctttctaatgttcattacctagaacctggaaaccaaatcaatgaattttctgactacagactcaacaaatatcatttgtttttaatgataatcagataatttaaatcagataatctaaatcaggtaatttagaaatatctgatttctaaactagtcctggactacacttacaaagaaacagcactgctatagagaaaggatgaagacataaattggagacaggaaacaggaccagattcagaacactattcctgcatatgagatttaaagaaatatacatacataattttacaactcctacaaagcctaattttatttgtaaaatataccagggtatcttagcaagtttctttggaaccacgcaactaagagtgctttttaattaattgcacatctagcaatccacaaatacgaattaagcaccatgagttggcactgaggagaatttaggtctgttctcccacagagcaagcaatttgcgaaactttgctctaaaacacataaaaaccctggccttagctaccaattttaaggatgttctattctgcaagggttcatcttcattctctccaaaaggatatgagggtcctgctgtatttcaatggaaccagacccccaaggctcagaaatcaatcatttcacaagaaaaaaagggtaagattatatctaaacatttcattagcataaatctgaatgtgtgatatttggtcattttgtcttagtttacaaccacctttgcaagtgataaaatatagattgatggtggggagagggtaggagaagaaaacaccacactcacatcacgggatctaaattccaccagcaggggtgggagctgaactggcctaacctgaatgtatgtacaaaagaattccttccttcctctctccctcccttccctcctccctcctcctccctctctttctaactccctcccttccttcctctccttcccccctccctccctctcttcctccctcctcctccctctcttcctaactccctacctttcttcctccccttccctctcttcttccctcccttccttcctccccatctcctgccctctcttcttccctccctccctccctcccctccttccttttttttcctacctttcctttccatcaacaagcccaggtgatggcagggataccgcatactccacttgtctcttccacggctggggatggctctatcagcacttgccccatttttaggttttacttcccaggtcatcccagatttataatccatgcataatgcaggcacctaagcacttctgggcccctactagaaatccagaggcgaacaaggcccagtgcctgcctgttctcaagtctccatgcaatgggcaccctagcggaaagaacacactctgagattaatctggcattgcaggggacttgcaggacctgttccaggtgcctgacattatctatctagaagaggtctccctttcagcacagttattgcctacatgaaggtggcctctctcaactgcacaggatgtgccattcgccaaggaatactaggcatccctccatcgtccagacagatctcaagtgagatgctcaatccctataagggttggtttcccctcagtggattacaacactcagatcccaactttccactgcacaggataccttgcagccatttggttttgaatgaccttctcttcccctcttcctgaaaatataagtttccttattgaagccaattaaagccaattctgctttaacatattctggagcacttcacagcatgctttaaattaagcaggaacaccctggtctagtggtactgcctccaaggcagtcctcccttcatctccctgcctccagccaataccctgcttctctgtctcctcagtccacctctgcctgctctgtccctggtttcctccacctagaaaagtgcatccaactgattttaagtacctctgacttaggggtaccacactgtgaaacctctgcttctatttcctcttctataccttgcattgcaagaaaatctaggctttttattcattttttagaaaaattagggaagtcacagcctaggtagttactagaagaaacaggcaaggccaagaaaaatagccaactcacatagagctcttcttaggtgcctagcatggtcttaagtgctttatagatactgaccattaaacctcaccacagtcctatgatgtagatattattagtgtgcccattttacagatcatgagcatgaagcccaaagaggctaattagcttgcctgggatcatcctctcttttttcttttttctgagatgggtctcactctgttgctcaagctggagtgtagtggcgtgatcatagcccactgtagccttcacctctcagtctcaagcgatcctcctacctcagcctcttgagtagctgggaccataggcatgccaccatgcccaagtagagatgggggtctccctatgttgcccaggctggtcccgaactcctaggctcaagcaatgcccccacctcagcctcccgaagtgctgggagattacaggagtgagccaccatgcctggcccatcctcttaataaatggtagggctgagatttgaacctaggggcctgactcaggagtgagtactgcttaccaggaagggaatgtggtcagcatgacaacaaaggcatctctgtcctccttaaatgcagcaccaactctgtaaacacacagcaggagctctagatacaccacgtttgtacacatttactgagtctacatttccatgtcaccttcaggaagagtggattggcttgggtgaggagaaggaagaagagcggagacttccgcccttgagagattctattttaatttttaagaaaacactgaacagaccaagccctggatttcaagatcagttttcgaggtctccagacatgaggcagtcatctgaaaaggaagacatgacagaggagtctgacctctgtgtggcctccttgctctccctgcactgccttcagatctcccagtgaataggaaaggaggggagacctgcatctgtggggcgagcatcccctaatcctgataggcttcaaaaggttgcgaaaggggccacattctctagtactaagacaatggcattaaatctaaatttcttgataaccaaactaaggcataaaggccagttaactatgtctagttctaatataacactctggaacatgccctgtgttatcttagcctagcttcctagaaatactgaatcgcaatattccacaatgcaagttcctcccactaaaggcctctttggagaaaggagttggctgtgacaaaggctgtagtatatagaggatgatcgttatggtggtgatgacaacagtgctgatagattagacaatagcaacaatgaccatgagggcaacgaagaccatgagttgtgcaacatctaatacaggtcaggggtgaatacttttgtgctgactgcttttcaagcattattatgttatatcttcacaacaatgatgagaggtgggtatcagcacaatgccccctttgaagatgaggaggagttagatgagaaaggccaagtctctggggcaagttgccataatttgggtcataacatgaacccaggccaatctgactccaaaatttcacattcttatccactgctcatctctctcttcctattagaaaaccttattatagaaagttctaaaaacgatatgctgattagtcaaattttctggtaaatacatagtaatcagttccaaatactcaattgaaaaaaattgccaaaatgttcatggtccccagtcctgccttagtaaatatagcacactaaatataaatctagttctactttattaatagacacatgatggactatctcccagctatttgccagaacaatctgttcttattgtagagtatttcagatgtaggtacagcattgagaaggaccatacactcagcccagggcatgctctgaaactacggtattaaacattaaaatctttttaaaaatgtgttttattatttgcctttttcttacaaaacttcagtccaaattatttgggttgataagtagaagtttcactgtagtaaactgtaccaatggctgcctgtggtatgtccagagtgtaagagagttgatgagaaacaacaaaagaaacaaacaaaaacttgaaaatataacaaaacttggcataaaaattaaaatgaccagccccctgatcctaaggaaagtccattttctcataggggcagtcagtatatttttatcttgtggcttaatgtttttgtagacacattaaatcataaaaatccaagaaaccatatctcactcccaaaccacacaatgtattttaaggaatatgtcccttttctaagaaactgcttgattttcaggaagtggtaaagtggcaggtgtgttcccatgatcagccagagaaaccaaataaacgttccactgggcaaacctgtttctcacagataaacagctgcgagctgcacgcgggagggaaaaggatcgtaaagactgcccctatgtctgcctgacactttctggttttctgtttcaattgaaaaggaagatggcagcctacaactgagcagaccctactgtggccaggccaatcccagcccctgcatgggacaggagtttcaaaatcccagcactagacagaaggctgtggtcatctctcctctaggtagacctgggaagggataattaaactaggagttgcaggagaagcagatttcccatgaaaaagacatcatcacacaattaatagctaggcttgataggaaggggaaggaatgtccctttttacttacttccaaggcagcctccaccttgcttctcataccacccatcacattggaaacaatcaccagtctgtatcctcagcagactgtgagctcctggaagtcccctgggcacataacaagcactcaatcaatgagaattattgttattacagtgtgtgttcaagaaatatctgttgagtgagtggaacagaggaaggaatgaaataacttgactttccatttggaaagtgtcttgctaaatccttgctgttagagttcaggagttgggataggatttcctatactgccactttggtttgtcatgttgtaagcagggttaaaggcaaatttttaaaaatatgagacagggctgaactggctttctgtctagaaattctagattaaaataagggtctgtctaggagcggggagccagctggctatttaggaggcttggaggttaaagcgaagtctaaatggagtaagagacactattccaaggggtcccctggtcacacagaaaatacaggggcagcattcagactacccaggagtctgcaggacttggtatgaaagagcaaaaagaaaaaaatatatagacaacctaggaggtctgaggactcacagacactgactggctggggtgggactggcaggagctgctgggaaggctggggcagcttctcagtggtcctggcagtaaatactatccaggaaaagtgtgccttgcagtgagagagctgctgggaaaacggcctggacaatcagactgcagtgctgtgagctagattgcccttcccctagccaagaggtgtctcccaccacccttcccctaagcagcataagagtgaaacggggtggacagctaatgcccactgacctcctgctatggaccacaggcactctcctgcgaaatgcttgtgaggttggtgacatcaacattacactaatgacaaaactgagcctgagaactgcaactcacctgcaatggtacacctgacagcagaaccagaactttcactgaaggcttacctctccagggccaaaagagaacctgtgaccccacaggatcgagcctgccccctcaatgcctgtcagaggcagcctggtgggtgcagaatgtgatagcaagttgctgttggcacggcctgctcttctgacagctctgcaggttatttctcacaactttgctgccagcttctccctgcctgtcgctgacccctgtcccagagccacctccatctggaaacacccaccccccaactctaaagttgtaaccatacatacttaagctagaaaatttaaaaggacaaagcagaaaggaattaagaaaaaaatggagtaacctattattttacagagaaataattttaacattttggattaattccttcacatacttttcttttgagatggagtctcactctgtcacccaggctagagcagtgcagtggcgaaatcttggctcactgcaacctctgtctcctgggttcaggtgattctcgtgcctcagcctccctggtagctgggattacaggagcacaccaccatgcctggctaacttttgtatttttagtagagatggggtttcatcacgttggccaggctggtctcgaacacctggtctcaagtgatccacccaccttgacctcccaaagtcttgagattacaggtgtgagccaccacgtcatgagccccctccagtaattttctatgcatttagatgcagatactgtttgcctgtctttaaaatggtgttgcaccagactaactgtttagaggtccacttccctgctcagctgagcactgacacatgcaacctgccacctgggaggatgggcaggcattcccgaaatgccatcatggctgctgctaaccatcccgggattgcaggcaagtgcggctgatgcagaaggacgttggggaatgcggacatcaggggtttgcaaacttgtgtttctccctccactgcccatcctgccagcctcagaaggttagccatggagggtgggccaatcccaacatactcaaaaatttaaaatcctgaagggttagcattggaagggattttagaggctatccagcccaatcccctcacttgcaaatgaggaaagcagagctgagagagatttagcttgtgctgggttctaacagtggctccttgccaacctcaggctcctcctggtctaccgtctgtgcctggactctgctccagcacccccacccacccacccacctgccccacttggcagagggcagcagccagagaaggcaggcccaggtgggggacaagagtctcaggactcacctttcaaatttaaagaatctctcgttaccatcaccataactcttagcccaaccattcctcttcagatccaaggatatctaagtctgactgtggaattttgttgcggaggattggatacagctgtcaaattccaaaggcatccagtacccatgctctccacagagcagtcccttattatacaagctctgcaccagctgagaaccatgttccagtctcatattgctcagaatctcctctgagcttcacataactcaggcacaatctccctgaatcatatggcataggaaagtcatgagcagtaagacttggttcaagaaaaaataccaagttctgaccactcaaagtacccttaggtgctctcattcatgtgagctttccgtttcctgctctccagccccatttcttatttgggttagggatcccctagggctgctcagtggtagggggccactgaattcaaagcaggccactgtactcgaagtagatggctaggaaaaaaaaaagggccagtcacagtggttcatgcctataatcccagcactttgggaggctgaggcaggcagatcacttgaggtcaggagtttgagaccagcctggccaacatggggaaaccctgtctgtactaaaaatataaaaattaactgggcatggtggtgcatgcctgtagttccagctacgcggaggctgaggcatgagaatcacttgaacccaagaggcagggggtgcagtgagctgagatcacctctgcactccagcctgagtgacagagtgagactccgtcaaaaaataaaataaaatccttccttccttcctccttcccttcctccttcccttcctccttcccttccccctcctcttcccctttcccttcccccttcccttccattcccttcctttcctttcattccctccctccctcccttcttccctccttccttcctatttctgagcacttctttcccaggcacaaggtaaacgagctttcaaatatagcacactgaatacccatgataattctataaaatggatcctattcttcccattttaaagatgaagaccccaaggctcagagcagtgaggtgcagatttactgtgatgctaaggaagaaagtttcagggccctgccagcatggacccctttcaaggccctagcaatatattcttagaatcatgtaatttttaaatgaaatttgcagtagtaagatattttaactgcaattgatgaagagcactgtatctttcaactctgatgtctcctcctgatacatttcccctcatgttcatattgaatggtgttacagtagctataggtgttttgggatccagcataagggaaagttaatttggggataaatttagtttgggtgtagtgggatttatgtctattgttcacagtcacgttaatgcaaagtcaagtgattgttagctgtccccatggcttccagtgctaagctttccacaactcaatggctttgagactcaaaggtgcaatacctggcacctgagacataaaaataggggagaaaaaataggattgaaatatacagagcggtccgggtgcggtggctcacacctgtcatcccagcattttgtgacaccgaggcaggcggatcctctgaggtcgggagttcaagaccagcctgaccaacatggagaaaccctgtctctactaaaaatacaacattagttgggtgtggtggcacatgcctgtaatcctagctactcgagaggctgaagcaggagaattgcttgaacctgggaggcggaggttgtggtgagctgagatcgcgccattgcactccagcctgggcaacaagagtgaaactccatttcaaaaaaaaaaaaaaaaaaaaaaaaaagaaggaaaagaaaagaaaaaagaactatacagagccagaagctagagcatagaactttcttccagtctttggacatgtggaattgaaggaaaatttagttttcactgatgcctattcgaaaaagaaagttttctcctatcagaaatgtatttgataatataatgaatacagttataaatataccagacattttccccctttttggtgggaattacacaaaatatattttatcaaaattcctgtattgtaggacccaaacctatggcagtaaaacaaaaaaaagtggatgtctgtgtctgaagccatgttttatgcaatgtaactatcaataataaaaaataaatattgtcagtcatgctagaagaaaagctaaattttctttgcaacctccctttagaaaaattacaaaatcactatcatatgaagaggtgatcaaagtgtattcagccaaaatatattcagggaaaaaagtattatggaggtttcacaggcaaataataaaaatattttgttatttttctggattttataaagtttgtgatacatgtcaggttttaaaaacgtatattgaatgtgatttattttcttattctaaataaatattcaccatggtacctaattttgtatttgtaattttatattctttttcttaaagaggtcccccagttgcttaaacttcaagccctacaaaatctcaacccatccctggaggtgaaataactttcccagccaggaagtggcagacccaggactagagaacttggtccctgactttgggatcccctgaacttcacacatttgtgcccagtcatccatagggcagcctgggctacaagggtcagggtgctagtggagaaggtcaaaggatgatgaatttgtaaactggataccatcactgcagccagcacatgtggcttctacctcacctgagcagacagcaagaggttttctgaagacctgagtatgcaactgacaaatcccgactctgttaaaaccaagtgcccagattaaagataaatagccccaaatccccaaacaatataattgaatctggtttgattcttctgggtgtcacattccctaaacttgcactgtccaaaatggtggtcctggccacatgcggctatttaaattaataaaaatgaaatgaaataaaaaatccagtccttcagttgcagtaaccacgttttaaatacttaatagccacatgtggccagtggtttctgagtcagacagtggagatatagaatgctcccatcacacccccaccccaggctctactgttaagcccagctgaacttttttttttttttttttttgagactgagtctctgtcgcccaggctggagtgcagtggcgtgatctcagctcactgcaagctccgcctcctgggttcacgccattctcctgcctcagcctctcaagtagctgggactacaggcacccaccaccacgcccggctaatttttttttttttttttttttttgtatttttagtagagatggggtttcaacatgttagccaggatggtctcaatctcctgacttcgtaatctgcccaccttggcctcccaaagtgctcggattacaggcatgagccaccacgcccggcctagcccagctgattttaaacagtctttactaagacatatctaagcccttcttctcaagaagagtgtttgcaggtgagtgtggccgatatgtgaggagagaggagaaggaggagaaaggaaggcctatccagagagaagagagggacagcccagctgagaaggggccaaagagggggaaaaaggaaatagaacctaaagtgactgaggtgttaggccttgtagagaataagggcatcatcagatgtgagccaaggaaatgattcagatcacacctgacagaataaggaggataaattagctccagaatcagttatcacatacctcatgtaccccccaacatacacaccatatacctcacaccccccacacacataccacacacacacatgccccccacaccacatacctcacacatgcgcacccccacatacctcatacacataccaaacacacacacaccacatacctcacacatataccacacacacatgcccccataccacatacctcacacacacaccacatacctcacacacataccccacacacgtacaccatatacctcacacaccacatgccacatacacacacaaagaccacacatgccacacacacacacaaagaccacacatgccacacacacaccacataccacatacacacaccacatacctcacacgctacacacacacacacacaccacacaacacatacaccacacacaccacacatacgccacatacctcacacaccaaacacacacaagcaccacacacacaccccccacatacctcacacatcacacacacctccatatacctcacaaacacacatatctcacacacacacacaccacatacaccacacaccccacacctcacacagtcccaccccacatcccctgctacacacaaactcacacactttaaagtgtgctttgcattccaagtctttgctgggaaaccttagttgcagctttacgtggctggaatatcaaaaggcaggagttgtggagtcactgacaataacatcatccaccttctcaatgtccccgacactgccacctcattacccaaaagccactgccattccagacctacgcagagtctgaagggcagcacccccttctccttgggactggagggacaccttgcctcaactctcctgcagggcctgaggttaaactctcctgtattccaccatcaaaggacagcatgggggactctagcccttttaatgggctgccaagagcaaaaattcacgcattctagagtatgaaagcccggcagggtgggccttcatttcccatatgttagtgtgtatcgatggagagggtagggagccctgtggggaatgagggcacccattgtcccctgcagagcagttgtggatggagctcctgtaggaataacggactctgattaccacggtgacactcccaaggtgatggctctggatagggtttgcagtctcctttatactcatcactcccatctaatcctcacaagaaccctgctccccacttaatgaacaaagaagcaggcctagaaaggcaagtggcttgcccggaattaacaataatagtttaaccataataacattgccccatctgctcaccatccaatgaacaactcaagtgacagcacagtggttaagagaacagattctgaaacagatgtacctggttcaaatcctggctcggccaatgactagctttgtgccactgggcatgtgattcaattaccctgtgcctcagtttccttgtctgtaaaatggggatgatgatagtccctacctcatgggttgctgtgtggtttaaataaattttcacatgtaaattacttagaaccaagcctggaatgctcagtcagcactccttaagtgctggctgctttggtgcaggctctgagcacagagacaaccaaacatagcacctgcctccaaggtacttacagcctaaagggagaaacagaaaagtgaacaagagctagggtagaaaagatgctcggggcacaaatgagggacctggaatccaggaagggcctgattcctgggccaagtgacaactgggttgagttctgaagagccacagtacaggcactgtgacagcccttatttatgttttccagcttttattgtagattcatgtgcaggtttgttacctgggattattgtgtgatgctgaggtttgggagatgaatgatccatggccctttttatatagtttgtcatttaatccttggaccattttacaaatgaggagcctgaggctcagagaagttaagcagcttcccccggaaaaccaacttggtaagtggtggagctgggattcaagcccacatttgtctgattccagaatcttactccaagtctgggcaaggcgtgggctggccaggcagctgcctgaagggcaattgtctataaccctggggtcagggggatgagaaatgtgaggcctgttaacccaggtctctgggcaagcttccttatataacctgcacattgtcaacgctccactcaggcagctctcccattccttactacataattattagataatgcataagggagaggtttgaatgactagcctgcctgggaggctgcctctctacggtcctgcttccaccacacgggagccctgaaacgagcaggccagctggagaggtggccaacacattcctcacccagaggctccgggctccccagatggccactgccacctgaccacacagagtcactttgccagaaggactgccctgctttaggcctgatctgatctttttccaggaaactcgtctggtgtaagatttatgtgtccaaacttgccagccttcccctttcaccctggactaacagggacaagaattctaatcaatgtgcaggaacacagaaaaaaaacagggaaacagcaggcaggcccaaccccaaaagccccaaacttatttcccaattttgggttgcacatgtatttctactcacataagacagtttgcatccaactggggggaattttgagtttcaattaaactttgctaaaatacaaaactcatttccccttaactgtgcttcctgacaatgaagtggtggtgtcacggggcagaagggctgatggtgtgggttaccacagcaaggtccatgctgcaaagacgggctgcccctcctgctctgggagtcaacgcttcctgggtccaccaggcccagcatttccacaggctgtcatcggtgtgtccccagcacagcacctagctagatctcagcaaatgatttgaatgtgtggggctccctccaggtaagaaaggaacccctgctcacggcactccccagaagtccttggtaactcactttctctttctgttctgaacatccattcgggctggtttaaagcacagctcgctcaagaggcagccctccagaggagatcggggttaattacgtttactgacagctgtcttctttctcctacagtcacttcttcccatgtcctgatttcattgcttgtgaaaagagatggccttccaatgggaaaaggcaaggagtaaaactcacgagagaaagcgtcctggagattttaaggagaaaggcacatcggttctgccagcacaagagctgcctgtttccctatcagatatcaacactcatttagtgcaagggtgaatatcacctttctattgaaaagaaatagagtaccctaggaaaatagcttgcatcaaaacaagagaaaagtaggttctgaaccagaactaaaatatttggacaccgaagctgtgactactgatgcaaagccattaacccataaaaacaaacattcaaacaagacactgcatagctctctttaaatgagtccaaacaccagagctttatcttaaaacaaataaacaacaacaacaaaaaattcctttccccatcccatctccacccacccactaggagtaaaacatattgctagctctgagacttttctaagaacttggtcagagacactgagcggctggtcaatatatttcttacaaatggggctttgagagcggaactagcagctgggtgccaagaacacagtggctctgctcacatctcacatatgcccagacgctctgaaccacagcctaccactgctgccacaggttcaagttctgaaacccaaagagagcacagagaaggcaggaagagaagaaaaaaagacccagatgttgcaaatcagaataagtgctgagtgaggcagtatcatgacatggcaacgataaatgttgaacgttggctctcctcttgtcagctgacccctctgctctgggacccttcacactgtgactccagttaaatcaaccagctgtgcctccaagaaaggcagcatgggtcagtgtggctgcctggactctgctgctgacagctgcagagagaaactcaaaccagccacatagcctggcccaccttatagtctgaacgtgcccagccaaaaagaagaaaagaaaacagctcaaaaaacagcaaaggctgggtacggtggctcatgcctgtaatcccagaactttgggaggttgaggcgagcagattgcttgagctcaggagttcaagaccagccagggcaacatggtgaaaccctatctctaaaaaaaaaaatgcaaaaattagctaggggtggtggcacacatctgtagtcccagctactcgggaggctgaggcaggaggacagctagtgcccgcaaggttgaggctgtagcgagccatgttcgtgcaactgcactctagcgtgggtgacaaagcaagatctcgtctcaaaaaaaaaaaaaaaaaaaacagaaaagcaaaaaacccacagctgagaagcctctggctcaaacccacatacagaagcttgtcggctgctgtgtgtacacataccagccaccatgatcctggccttctctgaccattggtctgtaaggaaataaggtgataagtgggaactgggctctgaaccctggaactgagaagtcaggctgctgcaaaactctccaggatattaatccctctctctgcccagtggttttcaactgggggcagtttagcccccctagggaacactcatcaatgtctgaagacatttttggttgtcacatctgggggtcagggggttgctatcgctacctagtgggccctggtagaggccaggtttgctactatacctcctacaatgcccaggacagctctcacaacaaggaatcatctggcccaaaatgtcaatggtgccaaggctgagaaaccctgctctagagcctaagagtgctgggctcaaattctaacatcactgctgactagcccaggggcctttgtataacttacttcacctgtcagagcctcaggtttatatatatgtgtgtgtgtatgtgtttgtgtgtgtgtatatagatatacatatatatttatattcatatatacatatttttatatattatatatttatatattaaatatgcatatttatatataatacattatataacatataatatatattatatatgaatatgaaaaaattatatattatatattatatatgaatatgcatatataatatttattttttatatatatatatataaattgtctttctgagacgaagtctcactctgttgcacaggccagagtgcagtggcatgatctcagctcactgcaacctccacctactgggttcaagtgattctcctgcctcaacctcctgagtagctaggattacagacactcgccaccacaccaagtgcagggattacaggcatgagccaccatgcccagcctattttatatatttaacaaaacttatgtagcagtttctaagtaccaggcactattcaaagcagttcatacatattaactcatttaatcttcctaatcaccctatgctgtagtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagcacgctgcaagagctcccttcctggccactttgcagaagagaaactaaccttgcgcagcaagtcaggaccctcccccacaaccaccccccagaaaacacaacagtctcacaagttttagtatggtcgcgtctgtaagcaaaagtaaggaagtcataagataagccccacgctggaaaacttgatccttttatgaaaggatggacaggctcactgattcaggtgagaaagaagcccaagtcctgagaggtgcagctgctgaagaccagggtggccccaagcaggctatgtgcaggctcccctgtcctctacctctcagtgaaggatgtccaggagatcccactcctttccccatgaacccagttcccttccatctgcccactttggtctccctgcacataaactcatctccccctacacactccacgtggtctggccccagccttcattccacccattttagtagactgcttccacaatgggctgttcagatccagggggtccaatgttcatatcagggcttcaaatgacctaacattaccagaggcaaaggtgcttaggttaaccaaaaagcaggaccagactgttggcaacccagtgtgctaatgcaggccacccaggccaatcagaagtactgaccagagaaaggcacatttcagactaaataaatatttatcttttttgaaattacttaaagattgcaatttgtttagaggtgtaactggaccccccgcaggcccaagggaaggctgttctagctaacggtaaggagaggagtagaaggcaaggtggaggagggccttctgaggcaggaagtgaggcatcaggacagggtgtggctgggaacatcccccaggaacacatcaagtgactgataaacatttatttgctttatattaggagaatgagaacacggcctatagaaaactgggagtgctaagggcaaagaaacggcttaaagacagagagactatgtttgagcaaagtgagaaaggccattcattggtaccctcagttattaaaataatatataattcaccgctaatcacggcactgcccggatgaatattaattgaatattatatacaacatattacacactgagtgactcatagttacttctaatgaatatcaatatattttgacacatttaacaacgtggagtggtggagggggtacttctagagccaggcttcctaggtgcgattcccagctctgccacttactagctctgtgacatgtggcgaatccctggacctttctatgcagcagttttccactctgtaaaatgggaataaaaacaatgtctaccacaaagtaaaactctcaatacatagtagcttttgttttttaaaaagcttcaggattcaagttgatgagtgaaatgtatgggcatcaaccagattatgagcattcctcttcttcagaagttagtgctgaattatctggtccttccttaaccactgtgaacttgcgtggtgtccaaagacagaacctttcctgtcaacacatgtggaggcaactgcattaggtgcccggcccactgcttttctgactgccacttggccagagctgaaattctactcaagtctgtgagtgaggcccagctcctttccaagttccttgtaatcccactcaaaaaggcatgctttttacttttcttttctttttttttttttttgagacggagtgtcactctgtggcccaggctagagtgcaatggtgcgatctcgggtcaccgcaacctctgcctcccgggttcaagcgattctcctgcctcagcctcctgagtagctgagaccacaagtgcgtgccaccacacccggctaattttttgtatttttagtagagatagggtttcaccatggtagccaggatagtctcaatctcctgacctcgtgatctgccttccttggtctcccaaagtgctaggattacagttgtgagccactgcgcctggccaaggcatgctttttaatgaactccagttctcctgtctcaaagaggtctatcacatggtctttggaaagaagtggtccctgctgtgacagaggatcctgacagcagtcatggagcgctcgttaaagaaaaaaatgattcaatggcgcttgctaacgaactatagggcaagctttatttagggaaaccaccaagattggtgtagggaccaccacagtggtgttttgcagtcagggagagagattgggatcaactccaaatacaaggaaaagtgggaatgcatagccaacgagaatggtgaaggtcagtggatggaaaattactgcagaaacatcagaggtaaggggggattctggctaaattggcctaacaggattcttgctgaaggcaggcaggttgaacagacatcacctggggcacggtagaggatgatgctatggtctgaatgttggtgtccccctaaaattcttatgttggaacctaataccagtgtgatagaatgaagaggtggagcctataggaagtgatgaggtcatgagggctgggattagtgtcctcataaaaaaggttgaagaaagcgtccctacccctccaccatctgaggacacgtagaaggcatcttttctgaagaacaggccctcgtcaacactgaatctgctggtgccttgaccttggactgcccagccgccagaatagtgagcagtacataaattacccattctaaggtattttgctatagcagcaggaacagcgtaagacagatgaggaacccaatcagatatcaagggtgatcagatattgaggatggaggattctgtctaaactggattcgtgctacagttggacagagacaaacacagaagctcaaaagttgacccctagttgaaaaaaatctcagaagagcctaacgtgtggtcatggagagaatctttgtcaggccccagatcaaggacagcatgtggtgggtgagatccacactcttagggagaggagatgctttgaatgacctaattctttattgctgggagaaggaggacccagggtagaaggaaagacctgagagagagggagagagagagagagagagagagagagagagagagagagagaggtgctgggagaaggaggacccagggtggagggaaagggcagaccagagcctcagagcctgccatccccactggcatcattttgctctcacagggcccctgcactctgcacaataaaggagttgtttaacctcccagcatcctgggggcaggaaatattggtttcatctatttgttgtttgtttcagtcttggtgcatcttggaaccaaagttctcactgtatggacacaaaactaatttaggttcttttaatccaacataagaaaaacttagtttcctctagccaccatcaatcaacacaaagccaacagggcggaagggagggcccttgcttcctggcagtctccctggagggggagggggcaggaagtgatctagaatccagtctcagaagaactgctgacaacaccctcaccaaaacgcatcatcatcttgcactcatctctaagtagtgcctcccacagcctaagagcaaaggctcataacttctatccacagggtttctgccatttaccattacctccctgtcctggctcaggcaaggaccctcagggctgagatgcatcttcaggtcagcctgcccacatgtaaacagatgatacatgcacacgtgcgtgcacacacacccacctctgcatgctggagatacacaggacgtggaataagtcctctctgagaatttacgaaggcacctggctgccatcagcacagagtcatcctctgtctgagttctgaaggtagcagtgtctctgcaggtaggaagagagacaaatggagcttccttccagctgaagcaagtagaggctttgttttctctctagagggttgtaagaatttattgttttggagaaataacataaaatctaagagcgctggttcccaggctagaagacagaccagatctattcattcagcaagcattaaaaattcactgcttaattaatacaccaattgctccctccttgcaaagaggaagaacagttcagccccatgggctggcatctttgccactgaggtctgcacaagatgcggatggtgaacacatgctacggccattttggatgtttccttgtagcatcaatgaggaaagaaaacaaaactgttaaaaataaaacctctgccactatatcctgaattatatcagcaagctcctttttaacaagatgttatgtccaggaaatgtatccatttactgattgttcctgaagaaataacttgttcactaggaaataacttaaaccagaaatgtgggctctcatctgatgtggtttatgcatctctaggtgttttcagtgtctcttgtctatttaatggactcccagaagagtaggatgtctacctaaaaagaaaaattaacgtttatactctcctgatgatgtttatgtggaagaaaacaaacatttgtcaaatgtctgttttttattttatttatttatttatttagagatggagtttcgttcttgttgcccaggctggagtgcaatggtgcaatctcggctcactgcagcctctgctgcccgggtttaagcaattctcctgcctcagcctcccgagtagctgggattacaagtgcccgccactaggtccagctaattttttgtgtttttagtagagacggggtttcaccacgttggccgggctggtcttgaactcctgatgtcagctgattgtcactcatccattatacatcatttaatctgccatgagcttaataagcattatagagtctaatcacctaatgagcacgctcatgaaagtgtcaccttcattgaatcatttaactctcctagtagctctatgaagtactattattaccccccagcttataagataggaaactgaggctctgagaataatctgcccaagatcctgtaagtagtaggtctagaattcaagcccagcctgatctttctccaaatctacattattgtccctgaaccaaaacattctcaggccatgatcttctcccctgtcagcagaatctggagcatctcagggttcatgttgaattacaaagccctgccctaaagcagatttattggaagtccagtgcttgtgagagttattctgaagggaaaaaaaaataaaatacatatatatatctcagaaagccttctctgcccaggccaatgcagccagctccctgcttaagaatagctgcccatgggcagggtttcctggccagcaattcaagatgtgcctgtgccggctttactctttaatctcagtttcctcacctttaaagtgggtcccacaagccctgtcctacagggctgctataaggatttaatgtgatgagaatcctaacatagctaacaaagtgcctggtactgggtggtcagtaaatgacagttattgctgctattacttggtagactcccaaaagttattctcacatccagtggagggaagaggagggagcaatcctcccttgggggtagagtattttgcatcaacaggttttagaatttttggtgcaaggtgagagtcaaaatctaacagacttcgtttattatattattgcttttacgttctcttcagacaacgtacccccttattgcctctccctgggctgggcctctctatcccttccctctccccactccctgtgctcccacctagatctcttccaaatttcccagtagagagggaatagagaggcagtggtggtatctttcaccccacatcccagtggtgatcacagcacttcagggaaaaagaaagcagccttcacacatatgggcctccctaaaaagcttcccaggaaaaaggaaatgtgtgtggaaaggccataactgggaatgaatcatctgttaggaaggctgaaggagagggagaaaggggagtggccggaggtgaggctggagaagtaggcagggcccatcgcctggggtggtgcataccttgggaagaattttcaattatctttagttcagcaagaaattacagacatgattagggcccatgcaaacattctggaagggtcaaggcaggatgtgggggaccggtgaggaatctcctgcagcagtcaagcaatggtggcctggagagggagtggacgtcaggatggataagtggatggattcatgcactcgtccttaggaggaggaatgcacaggacttggtgacagcttaagtgtaacaggtggtggagaggagagggtgaagtccggcttctggcccaagcagcttgggggacagtggtgccccttcctaagacagggtgcatctgaagaggagagactcacaggctgaggaaggggctggggtgtgggttggtcatgcatgtgggaaggtgctgagccgagttatgcgtgtgttgagtcatctaagtggagatgctaagaagggggctgcatttacaatcagttcttccaaagaggggtccagatgagatgcatggaaactaacaccaggggacgtgacaccttcacctaggggaagactacattgtaagaagagaaatcctcagacagagtctagggagctgcgatcctcaatagccaagcagaggggtggtggaggcagcagagaaggctatgcaggagaagcctgaaaagcagagagaaaaccaggagaggctggtgcctcagaagcccagggaagaaaacaagatgcagagttttaaacttcacaaaatgccactcagagggcaagaaagacaaagttaggacaatgtcactggcatttattaagacgcaggtcagaggtgctcttttcaggagcaggtgtggctgggcatgcaagggctgaagcggaggagggaggtgacaccatgcacacagcccaggaggctgcctcactcacaccccacttgcttagccccactcacttagcctatttccttcacagccattatcttaatgtgtgctgtcttgcttctttgtttacttgtgaattgccttcttcccttaaggtctgttagggcgagctccttgtctgctctattcacagctgtaccccagcacctaggaggatgcttgacacagaacagggattcaatacctgttgggtattgaatgaatgaaacagaagcagagtaaagtctggctaagaagtgaggagggggagagctgcaaagcccagaaactacccacaagaatgagccagtggtgaggaggaggggtgggttactgtccctgggaagtgggacccccagtttaagtggaggcttagggcagaatcctggacactaaaaggaatgcttaaaagggaatttgaggcattttctggtctgaaagacatccggcccacattgctttcacttaggtcatgttcccccaaaggaaatcctgagataaggattcctagatgagtgattcattgaagaaatgtccccagagtggtcggtaggagagtggagaagcaggacagaaaggggagaggccaagccaagcatgacctcaggccacatcccagcctcagcctgaccccagggagggtcctggaatgtaaaccgaacctcctgcaagtttgtacacccccaccccccactgccagggcaaggtggctgacctttcatattcccaccctaattaatattggctacagactgtcatggccaggacagaaactcccagccactccaactctcttggcaagagggtaatcctttgaagaaggcgatggggcaaagctttagaaacagaggctacagaagctgcaggatgggcacacagaagtggccgaagtgatccaacgccatctgagcagagcgccggcaatgtctgctactaaattgggatagagttttttatggattaccctggaagagcacaccaaacaaaccacttcattctgagggcctggacggtgcagggatagctaccatttagaatcgtttcagtttctattccggtaaagaatccttcaaagaaagacatcgaggctcttacagtgcagagaggtgctcttcttggacaactatagggtgtgaacgtagcacagctactaaaagtgaatgtgacacaacaattaagagagtatggtgagtatttagaaatacttagaagtcaaagcataaaaaactggataacttgggttacattcctgagacatgtttattattatcacagtactgtgatattgtagaatctggagaaataaaatcaattgaaataaaataaaatacatctaccaactaccatttactgaacacctgctatggatccaactctgtgctagaaatgaagcagcatctcccttgctcaaagctgattttcaggctgggaactagatggggctcctgaagcaattcaagaacaaggcaaaaacagatctatggaggtcacataggatgatgattaagagttgagccaggctcagcaactgcctaggatcactcccatttctgctgccagactctctgtgcctcagtttccccatctgaaaaattgagatactaagagtctttacttcacaagattcctgtgaaggtaacaggaggtgatgtgtgcaaggtccttagtatggtgctgatgaatgcagtgagcactgaggccttgttattctgcaattattactggaggtgaggctagaaaagaccacacttgcccgacttgtcctacctttctctcctcaggagggaccaagacatttatgcctggttatgaggtgacattagaaaagaaatcaaaaagcatctgtccttgtttcttgaagccagatgcaaccaagctaagcctgaaccaagagttgatgggcagctgggtggtgtgctcctctgttgagctggccaggagctaaggctgatggctttctgtccagggagccgtttagactcagagtacacacatgcttgcctcttaaaagagtattgggtcagcaaggatgcactgggaaagccatcagcatctttgcatccctactgaccatttcctgcccagcacactggagccagtgctgaccattttcctttttttttctttttttttttttttgagacagtctctttctgtcacccaggctagagtgcagtgatacaatcttggctcactgcagccacctcctgggttcaagtgactctcatgcctcagcctcctgagtagctgggattacaggcatgtgccaccatgcccagctaatttttacatttttagtagagatggggtattgctacgttgcccaggctaatctcgaactcatggcctcaagtgatctgcctacctcggcctcccaaagtcttgggattacaggcctgagccaccgtgcctggtcctgaccattttctgattggcagcagcaggagggccccagggtcaaacaatgcagtcacacaggcctgtgctttaactgtgcctccccacacagcttggtgaccccgggccagtgactttgacctctgaagcctcaattcccttgactgtaaaagaggtcctgaccttggctgcacattaaaatcactgggggagtgtttaaaagtccaaatacccagggcttgcccagaccaacaaaatcagaaccccctgatgagacctactgctgtaaggtaaaatggtcatcttctactcccagaagtggaattaagggagactatccatggaaggtgcttaccgccatgctttacacagagtgcgccgtaaaaggaggccgtgatatggtaccatttggagttcccagactctagaaacacctcccacaggcccacagaggattgtacttgaaacttcattcattgtactttatgccccactttggtgagtatcaaagatcaattgtgcattttgatttctctagttcttttgatcaccctggtccacaatcatgttattcttcaagagagaaaatggccagacccaggaagtgcttctctggattaagggctgtgaggttaaatctttgtttccatctctgccctcaaggacctccaatcccccatcctaataagagagctgccatccacaagggtccttggcccttggcttgcagaagcgggatgagcatctacaaccctggctgtgatgaaggctgccctgacagttacattcttgatagagttgcaggacaaatatttctgaacctgtggttcctttgccgtgtctctagtcaacatagggcttttagccctgtggaacatgaagatttttgtgaactagggtataaggatttaagagtgtaggtggggcctctctaggccctgcttcctacatagttgatgtgtctggacccacaactgagagaaggaacaaagcaaacaggtgggatcccttatagtttatagttatgtttttcagagtaacagacattcagggaaacagaaacagaactttagctcaagcagcaggagggggcagccagcatctgagctggaagaagagctagcaggtgacaaaggaaacaagcactctccatgcagtgttaaggcagtgcttatcatccagtgggaactggggtgccagggtgccaggcaacagagcagttgatggagacagttccagtgccattatgagctgttaaaaggggatctgacgtgtgcattccagaccctgatactacttcttgtccagtcattcaacaacatagtattccctataggcccagcatgtctgtctatgtatctgatttcacaatcccatgacataggtactgttatcctcactttgcagctgaggagactgaggcacatagaggttaagtaacttgtccaagatcacacagttagtatatgacagagttgggatttgaaccctgtgctcttaatttctatgccaaattgtctctagcttagtgagggtgtcaaacaggtcaacagacaattagaatatagtacagtctaagtgactgctagggactagcacaggtggtggcatccaaaatcccattcttatctgatgctcactcataggaagaaaaacagaagtacccacctggtgacaggctagcaggcacaaggatagacagaatgtgcacctgaaggagttcacctaggagagctgaggaggcacaaagacctgcatgtgagtgttcgtggcagcttcatttacaatagcccaaatctggaaacaatccaaatttctatcaacaggtggatggataaaaaatctgtggtggccaggcgcggtggctcacgcctgtaatcccagcactttaggaggccaaggcaggtggatcatgaggtcaggagtttgagaccagcctgaccaacatggtgaaaccccgtctctactaaaaataggaaaaatcagccaagcgtggtggcatgcacctgtagtccctgtaactcaggaggctgagacaggagaatcacttgaacctgggaggtggaggttgcagtgagctgagatcgcaccactgcactccagcctgggcaacacagcaagactctgtctgaaaaaaaaaaaatcctgtggcatatccagacaatggaataccattcagccacacaaataatgaattgctgatctacacaacatggatgaatctcaaaagcaccatgctaagagaaagaagccagaagcaaaaagggtgcatattttatgattttagctatatgaaattctaggaaaggcaaaactctggttttagaaaacagagttttgcaaggggatgggggtaggagggacgaactaagtgtgacaggcatgaagaaactttacgggatgacgggaatgttctatattttgatggtggtgatggctacactggtgcagatacttgtcaaactcattaaattgtacacttcaaaaggtgaattttattacatgtaaattatactcaatttagaaaatattttaacaagagacttgatgtcatgcagtcaaaagtgaactgtgctatgctctgaagctaacggtgagagttacatacgttctgcttcctttgttttttgttccttgttctttctttccccctttccttttttttttttttctctctctctctctccctcctttctgtctctcctcaaagtctaccacctccttttccaagccaagcctaggtgacaggcccctgagctgcaagtgtttccagcactgccattacaaattagtggaaatgatcagacccccaggcagactggttctcagcctgcttcagaggggcagatgttctgcaaaaccagccagtgacccacagagaagactggcaagcccgcaaggctctcattggacccctctgtggcttctgcctcccaggtagaaagcatgcatatattagatttaaaaagaggaagtgcctttccaaaaactactcggctttgggagggatagaggtcatttgtctttgtccaagaaaaacatgttccttccttgtaatccttgataacccctgaattgttttctccaagatagttagggacaggggtaggggagaggggctacagtaaaagagaaaaggaggtagagaggacagaggaagccaatgccctactactctgcggtagcagcaaggtgagctcttaccaccttgaactctgggaaagatggtaaaagagggaacccttcaccaaccagtgcccacatgactacctaagacagcacccatatgaggtgcaaccatatgaaggttcacttctcgctggatgagaagtgaacagagaggttaacagggcaaagaagcagcagtaatgggaaaagaacgtgagactggcacggttccctcccctgggcctgcgggaggcccatggcagccagaatgtccatctgctgtgccccaccactagtaggctcacaggaagggaagagaacaatgacaacccaactgtcccttgcgcagaagttacaccaagaagtgagcagcaggacccgctggcctggcagtaaaccacatcagagttatcagtcggaaacctcttggacaaagagagtttataaagtcccttggccaagaggcatggaagttgagttcagccaagcgcaactcagacacatgggcaatggaaggggagctggggatgccagctgccatccaagtcctgtttgttggaaattgagagagatagtattggagaactagatgctttcactttatttctccaaaagagagctggtctccaggtggtgaagcctataattctataaaaactggagattggagagataggagggtacaactctggcccaagacagaaataagcaaaaacaaaacaaaacaaaacaaaaaaataggcatccataagagaaaaaagtgagtggttctgggcatctagtaagtggaagaggaaagagaccatctctaatcctaactcactctgttccaggtttggaataaaagctgtatcgggagaaataacctgttaaagtagaattgtcaatgtgtagaactgaaaatcggccaaaaatccatcagctttctcaatttactaagaaagaataattaactccctagtacctgatatacttttgcatttaaaggctaaactacctatatctactcaatatcattcacttctagtaagactcttattggcaggtttaaagcacccctacccaacccactagcaccaacttgtcttttatcttagcctggaaagaacatgtatgggttacattactaagaacatagtatcattgaatgaatcattaaatagaccagtcactgtaataaatacatgtggatatatacattctgttaatagacttggcatagtctttcatggtttcaagtgttaaggtttattgtggtattaaagaaaaccttatagactttcattttctgaacgatagtggattcaatatatagccaactctactgaaaacactaagcaaactggatactatagaaaaactcttttgaaatgactgatgagctggcaagttagtaagacgtattcagtgagcaaaaactaagcaaaatctgaagcctagtataagagccaatccctgaagctagcttgaagacaatagccaacaaagtgaccttcacttttatcttttgtggcctcacgggaagaggagacaggataagaatttcccataacataaaggatactatcacatggatccaggaactccaatgaataccaagtatgagaaataaaaataaatatatacctagatacgctttgtgaaactatagaacaccaaacaatttaaaggaaccagaaggaaaacacagattattctcaaaggagacactcttgtctgtagacaagacagtagattttagaggcaacaatggaaacagaggacagttgaataatatcttcattgtgttggagagaaaataactggcaacctagaattctaccctaattctacccagtaaaaacctctctcaaaaacaaggggaaaaatagtgtatttgcaagcaaacaaaatcaagaagttgtcaccaacagaccctcaataaagaaaattctaaaagctgtacttcaggctctattggaaaataccaaaatgaagttggtagacctacattaatattaatcagaatagacttaaagactaaaagaattactaaggaaacaagttttgcttaattataaaagattcaattcaccagaaagataaaacaattcaaacctataggtacctaataacaaaggctcaaaatatataaaacacaaactgacagaccataagaagaaacagaaaaatctacgatcatagtgggagattataatacttctctcagtaactgattgaacaagcatacaaacatcagtaatgatataaaagacttggacaacacagtgaagaagcttgatctgatagagttacatagaacactgcatctaacaatggtaggatccacagaacattatgaaaagtgaccacataccaagccttacagtaagcttcaataaatttaaaaggctgggtagcactcaaacaatatttgacaaccatgaggcaattaagttagaaattagtaacaaaaagataataagaaaaataaacaaacattcagaggattaaaaagaaacacagctttaagtcataagtcaaagaataaatcatagtgaaaattataaagtactcagaaccaaattatatacaaatattacatatcaaaatttatgaagttagagtaaatattgtatagcttacaatgctcataatggggaaaaaagcctgaaaattaaaaagccaaacacttaccttaaaaagctaagaaagaaaaatagctcaaatgtaaataagttagatggaagaaaataataaaaattagtatagacattcataaactagaaaacaaaagatggagaggatcacaaagtcaaggattagagatagtctctaataacattgagaaaattcttaaaagaccatttaacaaaattatagaaggtattacaaatgaaaagtggacataaccacagatcccacagaacattaaaaaataacagcatcttataagtagcttcaaggtaaaaattttgaaaactcagataatatggataaatttctagaaaaatctaatttaccaatattgatttaagaaaaaaattaaaacctgaatacccatgatctattgaagaaattgaatcagaggttaaaaatcttcaggaaagaaagaactccagcctcacagaatctttttttgagaacagataaagaggaaatattctataacttactttacaaattcagcaaaaccatgatacaaaaccctgccaaggataagataagaagtgcaaattacagtacaacacactcatgaagatagatataaaacttctaaattttattagcaaaaaaacctagcaatgtataagaaatgaacccattacaaccaagtcaggtttattctaggaaagcaaggttaagttaacattggaaaattagtttaccagatattaacaaattaaagaaaaaaattatataaatctcaataaatgcagaggaagtatttaataaacatccatgtatataatttgaaagaaaaaaagctctttgcaaactacagaacaggagtagttccttatcctaataaggaatatcaaatccataaaaactctcattctcaagggaaaacgttgaacatgaaaggcaaagcttaaacgtttagaagaccatacaagaactgtccttaaggatgtcctttaaaagacacaaaatgttcaatgataaaggaaagattgataaattttattacattgaaattaagaatttctgccactgtaaagatactaaaaaagatggtgagaaaaaataacacaaataaggagaaggtattttggcaacacagagaaatagtctcctgcatatataaagaactcctacaaataaataagagagatgtaaactacccaattttcaaataaatgggcaaaaggcttaaagaggtacttcacaaaaaaagaaaatccaaaaggtcaacagcgtatgaaaagatactgaccctctttagtaatcaaatgtatataaattgaaagcagattagatactgttacacatccacaagatgggcaaaagtttttgacaatatcctacaaaatataaagtttttgcaagattagagagcagtaggagaaattgcagctggatatagaaattggttaaacacattggaaattaatttttgattaaagtgaaactcatatgacaccatagaattctgaactatcctagcagcactgaaaatgcccatagtctgtggccagtaattttattactatgtgtattccctaagtaaacttacacacatacttagcagggaacttgaaaaaaaatgtttacagcagcactatttataatagcaaaatactggaaataagctaagtgttcattaataatagaatagacatataaactgccatatattcattcaatggaatattatggttcagcaaaatgaaaaaatttcagctacacccaacaatgtgaatgaatccaggacgaaacatttaacaaccagttggtacagagtccaatcaaatgaagtcccagccctagtgccagagctggtacccaagaccccctgccatgccaggtgtaatccctttagaaaggagtggacttggagaagtaccataggagcacctgggaaagacccaggtaagcagcaatttaccaactgatatggaaatattcccattgtttgtcaaccagtgagccttactggtgtggtgtgcatggactaaacgtgagcattaagaacaaaagaataaaacagtgtgattccatttatatgaagttcacaaacacgcataactagacaatatattgtttagggatacaaatgcaagaggataagacaataaagaaaagcataggggaataaaaggtacagaaatgtccagaagatggtaatccctgagaagagaaggaatgggatagggtggagggaggtacacaggggatgtcaaaggttcaagtaacattctttttctcaaattgactggtgagtacataagtgttagtcataatgttattctttagacctttctacacagtttgtaagcattcgtttgcatctaggggctatttcattaaagttatttcaaaagatggtcacaacacaaatttaataagaaactctcatatcaaattgctgcagttcctgccatatcttttctagttgctgggcaaagatgctctcctcaattgtaattggtgtgctcttaaacccacttaaaattctaagagcttctccccagaccactccaaaacattcttgtgagaatctttccagtgaggtacagcaaggcccaacctccagggcacattatgctctggctcatttatttgatacaatcataatcatagtgggtttttttctcaaactttgaaatcttcaaaatgagggcatggagcaaatgactacattctgcttctcttgctaagatttcaatggtgatgctctcattttaagttctttaccagacgcttcagctgtgctatgcccaattcccctcatcaagatttgctgacagtcaggggaagtttctaacactgtattaagtgtatactgagggccagggaattggggggagtttgaggggctgcacacatgtgcaattttttagcaaacccagcagatgcttgtagattcaacactttttcagttatttgtgaacaacccctaatagccacaccacatggcaatttgtcttttctctggagcacaaatgtgaactgtatgttgcaaagccacagcaaagaacaagtcacttagctagagagggagtcttctcaaagacccagtaaccccatcccaagatgccaccagggaaacagaaactctctggaggtgaaagaaacttaatttccttgagtgcaaattgaaaaggcaaataattggtagcctgtgaatagtcataggaacctcttcactctggaatggaacctgattcaggaggaagtcaagagcctatgcaaatatttctgcatttgcaaacttggggatttgccaagggcttgagatgtatccactgaaaatgtcaagcgtctactgtgtagaattttgatggaggaggatttcaaaattcttcttctatttaaatccaatcaattcatgtttatcagggcatctctgatctttttgtttttaagagacatatttgctctattgtccaggctggagtacagtgatgtgatcatagcccatggcaggctcaaactcctggactcaagagatcctcccgcctctgtctcctgagtagttagaattacaggtgtgagccaccatgtccataattttatttttattttttttaagacagggtcttgctatgtcgcccaggctgatctcaaactcctgggctcaagtgatcctcctgtgtcagcctcctgagcagctggcattacaggcatgagccactgtatccagctcctctgatcttaagatagtttcaacatctaatgctaagcctggaagtccaatgaaagactcaatagactaaaattggtgactgagattcggaggagcatatcgtgtgtttataacactgcttttattttttccatatctttctactatttgtttattagcttttctttggatctcagttattcatacataacacatgtttaaaaagttgatcctaaaccccaattcaagggtccaccgatgctcagagatctcaagatttctgagactagcttccctatacttctccctggctttgctccccaaatctgaaaggcattttcagatcacccctacttcatatttagatataaagcttccccctttatccacaagaattccagctgcacctggcatttcaaaaacacttagtaatgaggaggggagacccatcagtcatgtactcaccacttccattgttgtcctgcctcccaagcacatatttccaactgtgaaacctcccaacagggcagtcctctggatagtgtggttcagtcacttcccaccaccatgcctcacctcctctgccttccaagccctctgggacttcagggaataccttttctccatcatattacaattagatacagggaacctttggagagttctgagtatttgtgattatattcaataacctgttactgacagtttcttttagttaaagaattttttcaagtaagttaccaaaacaatgaatgtatgtacatctagaaactgagaaatactcttccatgacttttagttaggtcctcacgttttccacatatgtattgaatttttaaaatactattttaaaagggtctacatttattttcctctacttttgtttttcctcttgcctttgttttggagcaaattttaactgaacacattgtcagagggtcaggccaagtttggcactgctcgtgtatctcagccaccttccagttttcagcacgatgtctgaactgaaaaaacaccattgcttaccataagggtgtggccatgacagcttgaacaacatccgggtagtggtaagtctacatttgctacacagatgtaagaaacagatagcagtagggtctacctctcctgctccatcttttccatcaccaggtctcttccaactccagaattaaagtcatcaagttggaacaactctaagtgtgtttcctgatcataacaagacaggttgaggttcatgaatattttctttagtattaaatgttagaacataaccactaataataacagtagcatagtagttccctgataaattttgacaaaagatcataaagttctcaatttcaacagcagggctttatagttgtaatataattttgaccagtaagccaccggctatccagaaacctcacaggtgccattatcatggatagttgcagttttttctctaagaatcatgcaaaaaaaaaaaatcttttggggatacttcagaactctgtctttttaaattggatgaacaaaatataattttaacttctatggatacatgtgggtcattgtgagcatcagttactatgttataaaacagagtaccaaagatccatcaaaatacataaaatttcactgaattgcttacattaaatgctcatatcagctttagaattccatgccttgaattcttgtgccttttaaatttttttttagtttttctgttttttactcttacttcttactgatacttgataaaagagctttaataatccttgcacagtacagtatcagttgcttccaatttgctaggtgcatttgacaaactaataaccaagcctcttaaaacttgaagtaaatgcagaggcctgaaagagggtataaaatttcctccaatgatcaaaattcataaactgtagctcatggacttatgacctttctcttgatttgccatctaggtcccaactggataagtgaaattatgtaaatgtgagttccagattgttgtggtattatcctaatacctatcaactacatagcatgttactaaacgtatctcatttttcttctcaagatagttcagtggtcttggtaaggttatgatggttacacctactttacagataaggaagaaaattggtcacgggctttggccaagtctgacccagaatgctagtgctgcctgttgatacagccagtgttttccagccctgcccgcctagtgcatctgcagatttgtaaatacactttgactccacaggaaacaggatggagaacagcatgtcagggactccttgatgggcaggatggagggcaaaaaagagccttaaagacattagggaattcacagagtagggagtgagagacaagttaaatgctatccagttgtcacacagctttcttaatgttatctttcatcaaatcatgtcctagaacctgccaggacttcagactaaatgcatcttcttcttgcctgtacctttcacacactaaatgtctcaacagctcacttggcaaggacccaaaggcagcacacacttctccactccaaggagggtggctgccactaaacacaatgggcggagacagctcaacaatagtgccagttgagcacatcttgatccactgccacagagttcacagtagtagttggccctcaaagcaaacccactggggtgttgagggcaaaaaaacaatcttagccttaaggggccagactttgccatcaaattaacaaatctgcccaacagccccaggctgaggcgctcaggggtgtgacaggagggcccctgttaacaattctgtatcctgtgggtgccttaactagatggagtggagaggaagcagagagctaagtgtcacaccaccctctcctcctgcctgcaggtgtcttagttggacagctgtccaccttccttgcaaaaaactcccacaatctttaaatgcaactatgtaaagggcctccagcctctgcaagccatcacaactttaaagagcatatgtcaaacagctcagacggcatctgaggtctattcttcagccccacagtatagcccaaccccagagcacaagtgacaccctagtggacaggaactcctccctacactggctgctcagcaggaccatgaagaacagctgggacctggcctattaccttggcttcaggattcattttctgcctggaattgggaaactggaggccctgcaggggtccttctcctgggtccaactgtctccagggtgcaagaggggtgaaattaccaaatgaaagttcagataagcaattactggctgaaagagacacaggagggtcttcagatcaacactgacccagagctaataccacactgtcctcagagggacacacgatcactgacctgtattcttcacatttaagttgctagaattattcctccttgcccccactctctccctgcccccagcatacacataattacataaagacgtcttaaacaactgtagcacccaacttcttcagtctgggggagagccaggagatggtggggagctgtttgggcacacgtctgatcattacataatcacacaaacatgggctggagaacactgccatgcagatcagttcagcaaacacctcattctccctctttcctcttccctccccccgtaacacccaaaatgcacaccagagttaacaaaaccgaagcactccaggtagccagtgggcacctggctgctgtggttacaatgccaagggctaccagaaacgtcagcgtataccagaaagagggccagggtgctgctcacccagcgaccagatctgcagaccctcttcctgcaaccactgcccccgaagttcaaggaagggcctagccacagaaatattcctgacctgcaacagaaaccaaaccagctacgttaaaggaaaccaatgccgagcctccaagttcctctgcaccactgccacactcaggagtcctcagcagcctggacaatatcattagggaccattcggcaccatcagtgtttccatttaaaagatagtaaaatgtggggcataacttggaggggacactctctctgctagcagggaggcaagaatcccctatagaataggagtttggtttgggtttggttgggtcaggttgggggttgggaaatgattttgctttaggaatattttcagggggctaggattaagggggaaaaagaaagctatcccctctgtctcagcagccagcatcatacgaatctcactctcaaccaagcaggctactgcagtccgcctaaacaatccggagcagcagccaaggcagcacaagaaaacgccggtgccacggaacgcgatgcctaagccccccagccgaggctcctatggagccggccgccagtgcgcgggtgcagagcccagcagagcctgctgcaagcagcgctggagcgcacggcgcgcatagggttacagccccgccgccgccgccgccgccgccgcctgtgattgacgcgcgggggtcacttgaggctcgcgccgctccccagcaccaggccgagcagcgcgctcagcccaccgggggcactggccgccacgcgcagcccacccggccggcccctgcgtctcggcagccggacaccttgcctaagaaaggcatacacaaaatggaatcgcagctcgctattctgcttcgcggtgcggcctcaggcaaaaacacaatcacaaggtaaaatacagcgcaaggaatccatccgccgaataaaaacccagagtcccctaccttcggccttgggatggcaaactggtcctgtgttctctgacccacggatccagccccttcttcatgaattattccggccaggcaggattttgtgcatttttttcatgaacacctgtttcaagtaaggggtaaagaccttattgaaagaattgtccttaaaaaataacctgtgcatacgtatgtccatccaggcatgcatgcgtgtttgtatacacacatatgcacacggaatagccatgtacattgaagcaccaaactaggcagctggataatgggagagtcggctggttgtgag

SEQ ID NO: 1744 - DNA, 412343 bp, Homo sapiens; identical to SEQ ID NO: 1743
  source 1..412343: mol_type = genomic DNA

SEQ ID NO: 1745 - DNA, 71637 bp, Homo sapiens
  source 1..71637: mol_type = genomic DNA
aagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttctctcacacatccagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatgacatgaacttggcaacttctgagaacaggaatgtctagtggtgcttctagcctaaagtgacccagtttcagataagacagtttaatccagaactcagagggagaaaagattaatattttctcctagggaaggatacccagagctaccacagctgaaatgggaataacatgcttaaaggtggatatgagatggccaaagtcccatgaggaatggcctccaggtatgatgatgaaatccagtgcaggagggaaggtctcttctcatagtatccaattgcaaaactggtcaaaattcaaccattttctcagggttattctaaaagctgttggacttgtactgcttctttggcttctctggctcttgttccagcttttgcagttacaaaatgagaaagacctcgctgtgctgtcctccattcagtgggttctggatggattgccagatgatgtgaagggctcttggtcatggctggtacctgcaaacacggagagtgcttatcaccattggactctactgtgccatttccatcatgtcaatcatggatagacatgagataaggaggatggaatcggcagtgggcaggacacaataggaagcgagggaggggagagggcaacagggtggaagggtagagagaattgcaggaagaaggagggacccaggaatggcccaacatcctcagagatgaaagattacagaaagagggcagaaggcgagagcagagaggccatgccagcttgggctggagcagtcagattcctcaccacacccttgtccctgctgtgcccatctgctgccctttctttgccttctggccctgtaggagccatcccagccccacatcccaagccctacctgtgactacccctcccctaagccctaccagagaaatgaacttacttctacccttcgtgggccgcatgcctccagctccagctcttcttggggctccagagtgtgccagtttcccttcaagcaccagtgtcctcaacctctggcatggtattggaatctgtgccttcagaacctcctttcttcccattcttcaggacgtttgtccctcgactggacaagatccagcaggagtgggcaacacaggaacaaatccgagacaccagactgagagggacaggaaggggaaacacggggcagtcctgggtgatctggaccatctggtcacctcattctagttcacgagtggacatttagataagggaaaccaaactgaatcagaactctaaactcagtgtgcagcagggtcaccagattgcttattctatggcacctgagacctttcatcaccactgatcttcacgacagatgcacgcagatatatctaccaaggacttagaaacccaagacagtttcatactttaaaaatgtgtggaaactaaccatgcacaaacttctccaattacatcagtctccccagaagcacatccaacagcactctgtcacaacttctggaagcagcctgcctccttgctaacccctcctccatgcagatgctcacctagaggagtggatgggacataataccaaggaggagagtgtgggtccagtcctagcacaggccaggaacattttctgctttagagtcacaggactgttcaccaagccaagctgaataaacatcttattgcaatatttgcacagacatgcaactacttgctgtgaccatgacagtgactggaatgtaaggatccatcagtggtagacccaaatcttttttttttttttttccaagtcttgccctgtcgcccaggctggagtgcaatggcgcaatctcggctcactgcaacctctgcctcctgggttcaagcaattctcctgcctcaccctcccgagtatctgggactacaggcatgcaccaccatgcccagctaatttttgtatttttagtagacatggggtttcaccatgttggccaggctggtctcaaactcctgaccttgggatccacccaccttggcctcctaaagtgctgggattacaggcatgagacaccacgcctggccggtagacccaaatcttaaagcacatactctactctagtggttcctaaactttagcatgcatcagaatcatttgtagactttgttaaaacacagagttttggttacactcctacggttttttaatcagtaggtctggggtggaggctgacagctagagtttctaacaagttcccaagcccagctattgctggtccagagaccacactttgagaaccactggtctaccaccaacagtgttcaatagtatcacctgtcttatatcaaaggaaccactaatgactcactcgcactcagccctgtaacctcatccaaagcagaggcacagaaaaggccaccacacacacaaagaaaaactgtttacaaaatgtttttattttaaggttaagaataaaaggagccttagggttcatataatctaactacctcacttaatataatattaattaaactaagcttagagagggtaacttgcacacagaaacaatgaaacaatcaatagaacccaaaccaggaaccccagcagcactactctcaaaatcgcaaacgtggagtcctagaaaatctcctaatttttgtcgtcattagagtcacaaggctcaagagtctgcaactggcaaattagggcttccccttctggtcctccatgccgaagcactcaggccatgccatggtcatttcttagtaaggctatgatggaagcaattcttggttccctccaagttcaactgtgagtccactgcctagaactcagaactggttttctcagaaatcccatagcacacgtggagggttcctgggagaactcttcctactaggcaccacattgttgaactgcagtgatgatagcccacaggatctaaccatcatgaagaatataatttcctaaaattccattctgagtttcaacttggacctgtgctggtccctcttcctggaaaactgctgccccagttttctcatgtcaggctccttctgtatgtttcctcttgcagagtatctcctgatcatctacccaagtagttctcactcccctcctgccagttacactgcatctcatcagccttctctacactccttatagccctagaactatataaaacatttgttcatcatctacttgctcattaccccctgaaagtaggatgtgagcttcgagagggcaggaactttacctttctgtctaccactataaccgcagcacctagaacagtgcttgggacacagcagattctctatacatatctgtctaatgaacaaatgaatgtacagaagaatgatgagagagcaccttcttcttcttcttttttttttttttttttttttttttttttttgagacagagtcttgctctgttgccaggctggcgtgtagtggcatgatgttggctcactgcaacatctgcctcctggattcaagcaattctcctgcctcagactcccaagtagctgggtctacaggcacgtgccaccacacctggctaatttttgtatttttagtagagacaaggtttcaccatgttagccaggatggtctcaatctcttgacctcgtgatctgccagcctcggcctcccaaagtgctgggattacaggcgtgaaccatcatgtccagatgagagcaccttctttcaacgtggtttccaaagttggaatttgagactttccttcctgtttctctcattttcaatagtaggagttagactactgagctttaatagaacgtggaaggagaaaaacgtgcccttaggctggtgttctcaatgacaggacagagaagaggaagttgcagggattgggggtggtgtcgatttacttctcagctctggtgtcctttcgcacagaaagcatgctggtgagtcaggtcttcctggatacagggcttgggaggcaatgaggtgtactggaatgagatgtttttgagaccaaagagttgggttcaaaccctcaaaaagtcatgtaaatctctctgagcctcatggggctggtagaaaatacccaagggatagggtgtttgtgaggatcaaggaagttaacatatgtggacactctctgtaaatagtaaaataatataagttgctattaaatgattattgataagaccacataggctctggagagatccaaataggtgaaatttctcggcatgcatctccattcagtcttgctgttttgccttccttagttctaccagcactctcagaccccaggctgctgcgtgggagccccggctcaagagcagaagccctaaggtgctggcatgggctcctcagagccccgtggggctgccagcagccacagcacagccatgagcagggcagccaacaggaagcccaggagaagaccactgtgagaggccacagagggacacagggacaccgtcatcggccctgagccaggggcaggtgtaagaaacaagccggaagccctcacttttggcccaaatgctttggataggccagaatcccagagacaggaatatcagagaagccagcttccctcttatgaccaggccctggcttcttcatgtccttagggtgggttctacactccactcccaaaagcagggcctatacttcttcccttgccaagaaggtggggtggatggtattgggatctttggatggattcccaagattggagaaggtctcctttctcagtcttcatgggctgcactgccaatttctcattgaccaaactttaatgttccaggcaacgaggctcttggctataaggtgtcctcatgttacagaaatcacctcctctgacccagttactcccaaactgtttccactcttccttaagtgataaccttaatgacaagtctcatgcaaacagtaatttcttatcctttcttccaagagttcagttcactccagcaactggctactaactacttacagctgagcacagatttcacgcagaactgtgtaaagttgtccttgggaagacaaacacagcagccagttcctgccaccaagcagcacacagtctgggtgggaacagagacttcacgtccccaccacgaatggctgtgttttagagttcattacctgaaaagaaacagggtgggaggcatgtggggaataaagtgagcaggctggaggaggtcttcttcaagaaaacagagactggcccagctctcttctggctccaaaatgctgtgtttattgggttgtctggatcagaggcaaattcttggatttctgacaatgttgctatgatgtaatgagggctagaatcttcttgaatcaggaaagtttcagggaggttctattagtctgttctcacacggctataaggacatactgagactgggtgatttataaaggaaagaggtttaattgactcgtagttctgcatggctggggaggcctcaggacatttacaatcatggtgaaaggtgaaggggaagcaaggcaccctcttcacaaggtggcaggaaggagaatgaaagcaggaggaactaccaaacaattataaaaccatcagatatttcgagaactcactatcatgagaacagcatgggggaaactgcccccacgattcaatcacctccacctgctctctcctttgacatgtggggattatggggattacaattcaagtgagattttgggtggggacacaggcaaaccatatcagaggtgttatatagtaaggagcttaaaaaacagaaggatttcaacgtgtagaaagggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctagagaagcctgtctgtaaatgatgatgaatgtgtgagctcaccaagggagaaggccagaggagctcacacatcgaggagctggctttcaagggatggggaaagaaaggcaccagagaagcagagcgaagacgtggaaaccatagagccttactaagtgtgttcactcacccggctgtacctagggccacctgttgtcctcttggatggaggcagatcggctttctctctccctctctctctccctctctctgtcccacctcctctctctctctctctctcagttctgggctgggacagggaagaacagcaggactctattacttcaggcaaattttgacagatgggccaggacctgcatacagggccacccagcaggcgctggggaagggagcctgctaaggggctgactgcagagccaggcccaggtctgaagggccacgggtgcctggtttcaggttggaaagggtttcaagttgggcagggttggcaatggagcatcccactgaaaacagaagagcctcacccccaccccactgactcctgttcgctcacccctctgagcttctgcccatgccgatccctgtgtctggagcactgctcagggctccctcttggcatattcttgctgcacttttttttttttttttttttttatactctaagttttagggtacatgtgcacattgtgcaggttagttacatatgtatacatgtgccatgctggtgcgctgcacccactaatgtgtcatctagcattaggtatatctcccaatgttatccctcccccctcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaaccgtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttcttgctgcacttttaaaacctgcttccaaactcaccttctccatgaattccctaactcttgaagtcaaaaatcgatcttttcctcccctatacactattctcacaacacttttcatacacaaaaatcagatatggctctatctcccccactggaccatagaactcctcagattagaaacggcactagggtcacaaattcaaatgctcacagagccaggcagataacataaatgggtgaagctgctggtttaggtgacatgggtggtaattgtcttggtgatggccagacaataggagtcactggaagctgtgatgaatcagaggggctggaatgattgattgattgagacagagtcttgctctgtcatacaggctggagtgcagtgatgcaatctcagctcactgcaacctttgcctctcgggttcaagtgatcctcctgcctcaccctcccaagtagctgggactacaggtgcatgccaccaaaggggcctgctgcccctcctgcccatatggagaataccagagcatgggaatgtgacctgtattaccagaactgcaattttcagggagaggccaggtatctgcattcttatatgaaattaccccatctttatgtgtcagcagcaaatccaaatttaagacaccatgttgcaagccaaataaaatgcatctgcagccagatgcaatgaaagcttgttgattgaaaagcaaatgaacaaatgaatgaaggaatagaaaagaaggagcagatgggtgggagggggaaacaggatgggtgcccaagtgtcaagatgccaagcggtgggctgggcacgctcaaggtgaccccgttgccaagctgtcagtgtgaacatcagcacggtcttgcttgttggctaaggggaagagaaaagcctatggccctgtgaacttagcaaccagcttctccaaaaacattacaatcagaagctcttgttgcagccaaaacacaggtgcagaaaacaagcgggcgttcgcacatgcacgtgcacaaggtgtgcagaagttgaaggctcagcatgccacaaattccgcactccctccaagcacaccttatgcctcatgttacagatgtcttgagggaggaagggagggacaatttagcaaattgggaggtgcagcaggggaaaaggagtcatccagccagaattctccccatctctacccagaaactccctctccttgctttgttgacggcgctgaagcttgggggaggcataagtgagcctggtgtgggactgaccctcagcctccaggaacactatcggcaggaacacagcccgtgtgggatgcctggggttgcaaaagaaaagttatttcaggttcaactgagttataatttattttttctaactgatcattactgctgcggctctataaataaccacctagggagtctgcttttctgctcccaaatcctcaaaaagcattgccaggttctctgtggtttctggcctgccaagcacacagcacatttcttttctgtgcagcccttcagggaatccttctgcagtgcatgccaaggaatctgctgagttctgcccaactcagtcctccccttcctgatccaattcctctcctccaaactggccatccagccctcctcccccattccacaagaggcccctctccctggacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccaccccaggaagggtggctgtggtttacatgaaatcaatttaagtgatttaaagaagaatgtatttcaagtacaactcagtttaaccaagtatagaaaaaaaaaaatcatgttcctgatgatgttctaaaggatgtacgtttaggccctttctaaataacatggggttttctccttaaacagaggaactagacgggaactaatattcatcaagacccactccacaccaagcaattttgtttcattttcacaacatgatgcctatgaggtatgcatcctcatgcccatcttgtagatgggagtcctgagaaaaggacttgctcaaagtcatgcagaaggaaagaggtaggggtgagactcaagcccaagtttttcccctgctacctcctattacctctctaagctagaagactggagtttcaatgtatgtttatttttctaactttcagattacttttgcagctcagaaagcaaggacaacctggatatttcaccacagttccttaacagccatataactctttggagttagcctctccaactagttaactgtgaaatctcaatcaatcaatcaatctctctctctctctctctcaccatttattacgacaatgaccataaaggctatggtcattcaggttgctttaatggtctaaaaatgagagcttatgtatttttgaatagttttaaaaatgatcattcctaacatttacaaaataatggaaaacataagttttacccagtaatcaatgctccacggaaggttaggtggccctgcagatgctaccacagcactctgctctgttgggacaccttttccaccatattggaatggactgtttccttgtctgactctccttctaggccggtgatccccaaagctttttggtcatatgccctaacaataaacatttgagtgtacctgcctatgtgcacatttgtttatttataaattatattcatgccctgtcattcacaaaaatgggaaaaaggatgagatgtgtgtgggtcatcttcctatgtgtctatctacttctcaatcataatttcttcctgccccacaatggaccatctcaccttccatggtctccaacaccgacatcccactttggagaccactctcctaggatatgtgctcatcatccctcatttattcatttcccactgtctccagtaacacctaccctatgctgggtactatgctaggtgctggggatagtgggtgaaccacatggacaaggatcatgttttccatagagcttacaatccagcgggtgaaacagtgtcagataatgtcagagagagaaaacagccacaagaaagtaaaacaagatgatgtgatgttaagtgatggagaatgtctacaggggtaagagggaagtcacgatggaccagaccagcagctcagcaaaggcctctgtgacctgcatgaggagggggtctagtgggagagggggtgcctgggcagacagaatgtcaagtgcaaagcttccgaggcaggaaagaaggccattgtggctggattataatacatcagtaagaagagaggctggagaagctggagaggttggcagctcaggctggagagtcctgaccccactgcttactggctgggtggccttgggtattaatgctatatgctgcccagggttattaaaggaattatgtaaaggattgaaagagtaaatctatgaaacatcaacatcagttagaagaatgcccagcacacagttggcatcaacaaatgactgcccctagggtctgtttacttatttatcattagtctcccctgtggcatggaagctgggcctggccagttttctaccctgccgaaccagagtagctggcaccatgcccagcctatagaaagaactcaatgaaaatttggtaaatgaatgggttttaaaaatgggtaatggctaaggaaaatcagaatttggctaaatattaaaaaatagattttcgtaaacaattttttctaattataaaagtaatgtcatgtcttcaatattttaaacaaaaatggggtcatattctacataccgcttagtacctattttccactccacatgtctgttacaagaggcaggagaatgtaagggtagggatgtgggctctggagacagattgcctggattcacatcctacctccaccactggccacctagagcatctctctgaagttaccaagccaaaggacatttgggatttttaaggctttttaacacatattgccaaatagtctttaagaaataggtgtgagcccatctcctcaaaccttcatctacgctgactgctaacctttagacaatctttgccaatttgttaggggaaagaacaacctttcattgttctaatttgcctttctttaattaccagggatgactaacagtttttcatttgccttgttcctcttgcgaattgcctgttcatgtttaaaaaggaagcccgttttcataattagatgcagcagagtaggtggcctcaaagtgaactccctaccgctgggaagggttgagcagggccaggtggttgcccatcagggaactgggcatctctgtgccttgtggacagcagaactggatgagctctgaagtcctttattacactgggatcatttcactcttgtccagaccagcaaaggtagcaggcaaacctcaaagaaaagatggcttgcggatcaacaactggattctgaagacctccaccaggatttcccaaggtggatttgatgcctaaacatctctcataagcttctgcataaagacaccccagttatatcggagagaagagtcaaatcgacatggttatgcctctagtagctacagcatgccacagtgggggaattccttaaatctcccccttgacaagatggaaaaccttcgtggtcatagatcaaatcctaccacaacaaacatgttcataatcaaggtcagcatagcacaaagactcctaaggtggggccagtggtctgtttatctcaagctataacttttttccctgctttgcatttggctttggtacaagaatttgacataaacaccctcctaaccccactcccctacaggtatttacatagcaattttctcctgagctggtcaaaaccctgctaggacttggagaattccattgtgtttgtagtaagcagacacctggagccagatagctcttagagaataaactattcttggattggaaagggatctgaatgtatctgacgccctccttttgcaaaaattttgcagtgttttcagaggaccttctacattttcactaaggggatatttccccctaatatctccaccattgccattgttggagtttcctgctgggtctggcccccacaggtataatgccagctggaaacagaacactcacatctcttaaattactccactaacgaagaagtcacacgtggaattagaattctggctaattttcctgtgggcacaccttaagcacacaaacctgaaagcagcagagcagcgaaactggcagccaaaataaagcaaaaagaagaacatcttccaggagggaggtggaatcagattgaggcaaagccaggactaggttcttggcaacgtgattaaaatcccgaactacgagggaggagaggccttgctgccagcccctcagcacactcgagccagggcactggaggtgggtggtggttaaaagctgtgtgccattcacagcctatagcactgcctgtgtccgtcagtatgggcagaatggctaatgactccaaataaaactcctacaccatgctccatctggggaccatgttatagctgaatacacaaagtcactttgtagcttgcccgataagtccactttaattcctccaaaataattcatggaggcctgtgagcacactgcaccaggccaagcactagggttataaaaaagaaatgaaaaaagaaaaacctagttgctctactctaagggcttatgatttaaccaaggagatgagattcacaatggtagctggcaatacggtaaatcaaggcacaaagaatccaggagtgtgttctgctagaggcccaagagggcagctggcattttcaggaggatgcaggtcagcctttatgggaaaatggattgagtttaccttgaagggtggggaaattttaggcaggtggctaagaagtgagctggcctctggggatgtggggagactgtgagcgccgcatgagacaggctctgcatcctgcacatgctgcctgcatttccagccctgggaggaggatttgtgcaagggaggcagagatgagagcgttgataggaaggaaggaggccagatttcagagaggtctgaatcccacacagagaagcttgggctttctccaataagctgcagggagcagttggagacttgtgaacagcagattaacataattaaataaaaacttcaagactttagctttttgtggggatgcagactagacgagaggtgatgagaacattagaaagcttttacagtgtagaccaggctggccacggtgttggcaacgggagagaaagaaatagatctggaagataccacaaagcaaatatctaaagggcttggaaacaaatttggccggggggcggatgaaggatgagtcaggggcagttctgaattttaaaacttgggggatgtgaggtggaggtggcatcgtcagacataaagacacaggttcgagcagctttacaagaacttaaaaaggccagaccacccaaaggtggcactgactggaagcacgaggctacggacaatgcttcctcatttcaaaggggagttaacaagttaagtgaagttttatccaccaatgaaatggctgtctgtccaaacaaataagcaacaagtgtgggctctgcactcctctccacctctcttgctccttccgttgatgctcccctaacatttatctgaccataagctaagagcagtcatgagaacaagatagaaatcctcagaaatccagaactctaatccttccttctgctgaaatactgtagggcttagttattttcacacttatgcatatgcttcagtgtgtaagaactgagtcattgttttcttttctcctcccctctcccctctctttccctcctctttgccacccagcacctcctctgcctccacccccaagccactgcaaacatcctggcatgcatctctccccatccatttctgcatggctgtcaacatttcccattccctccaagcttgcctcctgcctcctatttctttagacacactgggagtctaagaaatgaactacagattcaacaggactgtggaccacagatcttgacaaagacaggcagcttgttgtgaaaagagaattggagggcaggtcagagacttaggttttaggagtcaggcaagggaatcagataaagatccctgaaaacaagggatatcatcactgcccagctttactgacgtagagacaagttttctcacttggcagatatagacggaagataagcaggttccctttcagatggtaaccccaagtgcagtggctcacagctgcagttattctgaatggcagcgggagggaaggaaacaatgaatgcacacacacacaagagcaatgcttaaggtgaaatggacttgaacagtctcaaatgcacacctcctccagttcctggaaggcaaggatgagtcaaacagaagttgaatttcacaggcgttcctcctccactgtcacatacgttcccagacgcagagtcatctgtgcacatgtcacccagcatcgactgctaccagcaactgcctcctgggaagttaagctgcagggtcagatctgcttctgctggggagctgaaagtaaactgcgtaaggtgggggtgatcccagtaatgtgagggcaggaaaaagcagagaacgctggaaaaggatggcaggaattaacatggctctgaagagaggagccaaggatcacctgatctgtagagcctggaatctgcagttatttctagtttcctagacaaccctgactaaactaggaagacatctgaactccggctcaaaaataatataggttcttggaatgggacaaaagaagaaaggaaaggggaggtgataccatgtgccagttcagggagtggggaccagaccttcagagaaaggaaggtcttcccaaatggaagctgaaatcccagtgggcattatgctttctgtacttttgcatttgtagccaagagcatgattctaattctggttctccagcggaggtgcgggcagcacatgtgcatgagttcgtcaaaattgatctaacggcacacataagatctgtacatttcactgtatgtaaattagatcctagtaattctacctctctcaattagttggttgtgtgaccttggacaagtcatttaaatttttgtagtccaggattctccatctgtcaagctgaagctaagaagctggcctctaagtttctccctggctctaaaatttacgattgtgagagctgattattgcaggaaatgagcaaatacatccagattaagaagggccgcaactattgatagaagctaagaagaatttctgaatgggattagccatctgcagaaaattccccctaaatcatccatcctggaatcagacgtggagagaggtgaagattccatcctctgcaccaaaaggaagtggcagcccctcctggctctgcattttcccctccttcccatccgctctcccctacagactctctaaattcttccactggagattccccaagggctcaggattgggacaggccttttcttcccttccttccaaatttcctttgggtttatagcaccctggtcgggttcacaggaagggaaaggagagggaagaaaccattcacatttgggtgtgcgtagcaagcagagagctggagggttacagaaacttagaggaggtcagagccagacaatcatctccccatcctatgtcttatggataagaaaatgaagatgcagaaaactagtgtgacttctcaccatttctaaagccccggaaagaacagatcaaggaggcagctgtggccatcttcaggctggttctttcacatagagatgctcctacttactccataaatagtttgtcatgggcaactttcagacagaggagctggaactaccctaaccgggcactggaacatgtgtaagtagaccacctggctcacctgtttctcttctcagaggggctctgagtcatgaggagaacctctggatatgcagaatggataaactgcttctgtcaggatggaaaggaattcacagatgtcttgccagcagctaaccagtgacacagctgaatggtagcaggcccatggaaacactctggataagaaagactatcaaaggagcatcaggtccagattgcaaattgctttagcagctaacataggcataaagacagaacgacccactctaatccaagggggttacgcttcagcgctggctgcctctgactctcacccttgacccagcccattcatcagtatgttgataagcagattctcttcacagagctccttaatctggtttcccagggaggtcttgcagagattaatgagagcactgtgcttcctgccagtttttgaggctgggacagttaaacagcaagggtgaaggagcttgtcataaagtacacaaaccatcccatcattggacttgaccccattaggtggttaactcaaacatcttctcaatgtagacacttggatctattttttttattcactctctccttggtagccagcaaaattaaagcccttcctcatatcatcgttcacgccatcttttataatagtcacagccacaacagcagctggggctaaacaaagattaggagcaataaggatcagatgggacagacaggagatctggtcctaccaaggggcatcaccaatgagctggacccactgtgcagcccacctgtcaaatgccatttgccacctctggcggtgatagcaggggcagctggggctgaatccatgaatcctgaggtctcacagaagtacagccacccctgtcatctagcccctcccctcagaatatgctctggggagctgtcacatcccacactgcaggctgatggaagacacagacacactcttgggtcctggcattatcgctgtttcctctggttacctttaaagaagggcgtctctgagtgctgggtcctccactggaaataatgtggggaaactggatgagctctgcagagatgagaattattttgaagcaaagtaagaaatgaccagggaactctagattggaatacagcttgtgaattcctaggtaggtgtagactcaagagtttataggaacttatatttgctgttattttttaaaagtcttaaaagttaaaatttacagcaatagcaagaaggaggacaaagtgcaacagctttaactatgagctaataccaaggttaacactatctgtccattacacgtagctttgggatttggcaaaaaggaaaaaaaaccacataacacggagctttgagctcataaataggtcccaaagacttgacaaataaactaacaaggcttttatggtagaagggagcatcgaaatctgaggccttctgtgccttctctccccgctgctgtgatggcagctggcaactgggccctactgtccattaacaaaacagagagacggataactatccagccgaggccagcttcctcacaccaggcagatccacagtggactctcaggaatcttcagcaccctttacaccagcagtggtcaaagtggggggtgcagctgccttgggactgagagatggggatggacacatctgcagggaggggtcaggctctagcccctttccccaggccaccactcctcagaggctggtcctccaccccagcttcagggacaggggatgcatggtggaaaccactgcagctgctgcattagcaaccttcaagagccaaagattctcttctctctagccagagagggaaggcaaacaggttagggtgacctgcagctcagggtcggccccaggccaggccactgcctgtactgactcctgggcctctatgcagtgcactccactttctagggcaggctgcttgccaaggattcacagtggacctggctgctccctgtgggactcactggatctggacccaggaccaagcctgcttgccaggagcagaaggtcaggttggtttaaaaaggtaacctctgtcctttcccagttccgttcctttctcttccccagctacctcctcctcttctccaaatcagccttctcttggctcagtttctgaccttgggtattttccccaaggaacacatccgaccatcaggcactcaaaggagcatgagcctagtcttttcctcaagcaaatcaccccggtacagtcagcagctgcagagcacagggagctcctggcatgctaaaggtcatttacagatcactgaaaaatctggacaagatgctaatgtcccagctcaatgcccatgtcctgacttaaaccttgactgtgtcttaaggacactcaacgtcaggatacctatgacagaaagagggacttctgagtatttcaggcataacaggcaaaacagacatctttaaagcttgcaaaatatatgattctgtcattcctctgcatcctcaccaccaccatgatggagagccagggccagtctttccaatcatcactcaagcttccagtggctattgggcactctccctcttagagaggggacactccagcaggaactccaggtagagagctgttctgcagtgggcatttctagctcagggccagcctccgagactctccaggagtggcatgaaatgaggtggatggggcttccttgtcctggccatcatgtgcctacagcaggcattggcaagctttttctataaagggccagaaagggttatggaccatcttctttgatgtttttattttacaactctttagaaatgtaagaatcatccttagtttgaggtgccatataaaaacaggcggcaggcaaatttggctcacaagcaggctgcagtttgcagaccccctcctagaggaagatgctgaggcctcaccaagcagcccctccccaccttccctctctagcctgactcctccagactcattccagctgcacgtggcacctgtactaggccgcaggatggccttcttgctgcaggcatttcaatgagaaaatatgctgcatggatcatgagtgattctgtctccctcgtgcttaaccttggaagcacaaggccctgctggcctcacctcaaggtctcacctgcccatactcatgcgaccttgtccaccatctctccactacgaggtgccatctggtaaatggcctaacttgggttcttcctcccacgcctcctgtgtaggttcagggcagggagaccaaggtaaatcctgtcagttctatctgaaggcagagcctggatccaatcacttcccacccctccaatgctatcacctagaacacagccacagcctcccatctggactccctgcttcgatctctgccctcccccctccccttccaaaagctcccagaggctttccatctcactcaaaataaaagccaatgtctctgagcagtgaaagccacccaccatggtcatccaggtcctatcactgacctgctgagccccaactggcccgcatggccacctggctggcctcagtgcctcctctttcccctagctgatactaactccagccacactggcctccttcctaccctgcttttcctcttagccatgaacaccatcagtagttatataatagtttgtgggggtttttttttttttggtcttgtttttctcactcaaatataagctctgtcaaatagagtctgacttcagtgttacactccagggcccagtgtcagccttgggtaggtgctctacaaatatacaaatatttggagaatgcatggggacaggatgccctgctgatgggtgagagatggtggcactgtcatgacactgtgtatcaatttgcacttggatacttttatgcaaataagtctcttgctcttaagtcccctcctcccccgccttagtagccagatgaaccgataagacactgaaaacagatacacccctggagacactagtctccaattttttgtttatattcaaccctaaagcaataacaacaaactcatattccaactgaactagtcaattatctcaggggaaaacaacaaacgattgctttatggtttagagcacacctgtgcgtggctctcccgcactcaccacaaccaccctcccatgagcacagcaaggaaagagaaagcatgggcttgctcagcagaggtctgggtttcaaatcctgacactgccatctataggtggtctgattctggacatggtaccaagtacactaggccttagctttaccatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctgtgtgtcacaagcaagggatcaaaaaagctaagagaattcacctgccctggatatcaactgcccttaagagatgcaaactaaaggtgactgccttcctttccccaagagacaaacggaaaccccactcagtgtgagaagagcacatgccatggaggccccagaccagtcagtgcccagtgaggagatgacagagcctgacgcagctacatctgagatcagatgccaaggacacagcaaagactgatgaagccatacgtgagacaccaaagtacgaaactcacattcaactcaaaggtttccatgtttgatgactgttatctccctgcacagtgtttttctttaaggagcacatgtgttctataatcctataaagtaaatttttgaaaaaaacaaaatgagaaacaaagggacacacagaaactcttgcaggtgacggatatgtgtattaccttgcctgtggtgacagcatcatgggtgtaagcatatgtcccaactcattagactgtacacattaaatctgtacagttttttaatatcaattataacctcaataaagttgaaaaaataaagaaaatttttgtagaacaaaagccttctcccattagctttcatcatgacattgaaatgtgttcctcttgaaacatattggcccctgacattataaaaatataaattattaaggaacaaatcttacaagtaacacgtttggaggacaaacaataaagagatggcctaaacaatgtctaaacagatttgaaacggagcagaatgtgagtgcgtctgactaaaagaggaggcttttctcaagtgtcagtcctgagacaaggaccctgggactgctgacatcccaaacatagtgcccctatgactccaagaagggaaggtgctgcaggggtgacggtccctccccaccccaccatcctcatctggctgatccctgctcatgcctcagaccttagctgaaatatcacttccccaaaaaaagccccccagcactagattgggtgactcattcactcattcactgagtcatccattcaacaagtgattactgaccccctagtatgagtcacattcgacttatcactctctcttttcaacgttgcaattaaataatcacacacacaatactgatttactgtctgtcaccctccctaaactgtcagttccaaaaggacagagattgtatctgatttgtcatttcattcccagcgcctgacacagtacgtgcaacatggtaggcatcctgtccatactggccgggtgaacgtacaaatgaatgaattaaagcatttgaaagctccattcatattctaaaattccaaaatgcaccctgctgtctactttacacagggataattgatgttacaatcaatatgacttttaaatttaacaaacgaaattgttttatttattaatctactagtaagtgaaaacaataagatgtaagacaacaggaagaaagttactctccctgagaggacagaacctgcaggtgttatcctgggactggcagaagcagcatagggtcatcgctgaggggagtgtggatagagtcaggctatctgggttagggtcttgacccctccactgaccagctatgtgactctgggcaagcaacttaacctctctgtcttccagttttcaaatctgtaaattgagaataagaatatcagcttcagataatttcattaacaagtaaatggattacgacacgtgaactgcttagaacagtgcctggcacgtgctaagtactcactaaatgtcagttgtttttattttctggaagaatgggaacaagatgggttaaaaccaaggacttggacatactgtcactaaattcacaaaccactcagaccaaatctccaagatttcctattacaaaatgaagtaattcaaaggcaggtggctggatgggttatctactccaacttccagacttactgctttacctatagaggtgatgatgccttatccatctgaaattaagggccaggtcaaacaaaccctcaaggtttctccaggactggagtctgggatttgattttatacaccccacagtgcccagcacaatgacgaacatgcatttaaagcttagaaaatgttcactgtgttaatttacaatgaataccatttaaagctaaaaaaaaaaaaacccctgcatattctaaagtatattatctagcatatgtgctagccccagaagaataaaatgcagaagtgaacaggagttgcttcatggaactgaaattaattatacacaattatctctgagatctttaaacagtaagtgaacaatgaaaatgtagattcagaattctcctggtaatgaataagatgatgaacatgtttccacagagggtgggatcaggttgatctgctgaaataaccagatagcaggataatttcactatctacgtgaaacattatccaagaatctgtgcgttactcgacaattaaatcagttcaaatgtcttatcaatgatttcatagaacaaccttcaatgagttaacaggaacccgtagataaaagacaagaatagggctacgtcaagaagctcaaaatcctcagctgctgataatgcaaaaccttggccacattgatgagcccaagaccaccagatctctttatactgagtcattttttaaagaaaacttttattttatatgttagttttccttataaaaataagttgtattgaggtataatttatatacagtaaaatgcaaccatttcaagtgaacagtgggttttgacaaatgtatatacccaagtaaccactaccctaatcaagatataaaaacttccataatgccagaaagttccctcatccttgataaaagaaaaacttcagccgaattaaatttaaaggagtttaattgagaaatgaatgactcgcaaatcaggcagcccccagaatcacagcaggttcacaaagactccaatgcagccatgtggtggaagaagatttacagacaaaagaaagggaaatgacatagtacagaaaacggaagtgaggtacagagtggcgggattggttacaagttggcatttgccttatttgaacacagtttgaacacttagcagtttataaatggttgaagtatggccacagggattggccaagacccagctattgttacaggcacatactcctaaatcttgtctacctattaagctaggttgcaattcatccacaagaactcaaatatagaagtacggagtccttctcaggccatatgcagtttgctttaacacactctttctcggttaatccctgctcttatctccctctatcccaccccaaggcaaccatagttttgacattccccctatagattagttttgcctattctaggatttcatgtaaatggaattgtacaatatatatatacttgttgatatctggcttctttcagtctaatgctttgaaaatccatgcatgtttttgcatgtgtcggtagtttgttcctttttattactgaataatatctatttgggtggactgcaagttgcttatccattccccagttgatgggtatttgggctgcttttagtcttggactgttttgaataaagctcttatgaacatccacgtacaagtcttccaccaacatatgtgttcacttctcttgagtaaatacctaggagtaaaatcactgggtcatatgctgtgcatgtttaactttctaggaaaatgccagatttatcctgaataacagaaatgatcaactgatttactattaaaggacttactggattttataaggaaaagaggaaacgagacgaaagaaaatgtagtgcatctgaaagcacatgggggctgctttgctgaaggggctggcaggcggcttcccaggcagggtctgctcaggactgctctagccagatgcctcccctggtgtttacttcacccacaggaaaatggccaccttcaccccaccttcagtggacgtgcagccccttcggtgctcctctcttcatctgccttcagaggtagtcctgattaacctgttgccagcagaattttctaggagagacaggacttgggggtaccactaggccccggggacatgcactcagctggcccaggcaccgataacctagcatgtccttttagaatttgggggatcccggcacccactgttctcagctttgggcctcagctaaggccaggacaagcatcatttaatgtcatgtcatataattagtatggaaactacaaaaacctatatgtttacaaaacaaccactgatctacattatttcagaggtaatgatacttttacatgagataacttcccaagacactaagctgaaattagataaatttaggttttctgtattctcgctgacttgtgtttttcacactggctttatcttggtttctgagggagaatcaattctctttaactctcttccagaatacctcactaccttcagaaaggaagaaggagggaaaaaaggacagagggaaggaggaggattagaattcctcatatcagagaatcccagagctttgaagctttaaagtgaattcaagagtgggattcaagagaccaaaccatggggtctaggggaaataaggaacccctctcccagaaggtggagaagcttctcaaagcaactggcccaggcagccttgtacttgcttcattctggggtcaggaagaagctgcaggccctccttcccaccctcgcttcccttctcctccacactgtcaactctgctccaggaaggggcagtatccccagtgtctgctgggccagcacagccatctctcacccacctgagttcataatgactcctgtgtagagcagacttcccttggcttcactgaaaccattccttcttgtcttagaaagcaatcagaaatatagttaactgccttaaagttcccttatcattgaaatgaactagatcacagaagtgcctatttgcattttttattcttattcactgggtttttaaaaggagccaagagaggggagaggaaatgcatttacttgctgggatttcacttgggatgttcatgttcgtctggaaagcaaaataaaggcatgaagattgcccactgatttcctttcatttggagaattctgcttgagttaggcttagctggctagcacataaacctgtcaagagaaaagtcttcctcttcctgggcctggtatgtctaccacctggggcttcagagacagtattctaggagattcacagtgtctaaggttcgaaatgtggacttcagcagcagggcagctgccaaacgctttcctgcccttgcagaaagccaccaccaaactcaccaccacctccctcaccgtggcctctctgtttcagtatctgagcagcgggtgaggaggactggattctagaagataaagagagactccacggtacagaaagtaagccctcaataggattctattagaaaacagctggaaggaactgtggagtcactcagtcccatggctgattttacagacaataagcaaacaaacaaacagaggccctgagggatttagttagcggtctccaagtgccagtccctgaggaaaggattctcctccccagctacctttcccttctccagtgtgtccacctcaggaaaagggcttgcatcctcccagctgctcacacacaacttgggctggccttggtgctggctctgtcctttctcccaccagatctgccttccgccctcgccacttgtctctgcccagggctcacttggaaggaccacatcaatgaacaaccttggcaggtcacagggagggatggagcgggggagagaacagcaaataggcttctgccctgcaagagagggagagccagaataccagcctggcttgggctgctcccgaaggtcctggctgctgcctgcaatgcagcgccttccttcagggctccagcaccatcccctgtcctcagcctttaaggctctactgctctcagccccagccctgcccttgaggctcccctgtaccctgtctttgtagatggtgcctgggaactgtcccgcttggagagtgctgtttgctaggatacacactgactcccatggctcccctccagctccccatccatcctgctcctggccacggcctctggcctgaagggctgcaaaacagccttccaactgggttcctggcttcccttctggcccctcttcatctgctgtccccagcagcatacagagctatcccatgaaatataagtcagaccatgtcatgccctggcttaaaacctctcaatggtttcctctggcatctccagtaaaaatcagaactccttgctgacttttgagagctgctctagacagggctgctctctgcagcctcctcttgtgccccgagcttcaggacactccagcagctgtggggcctcctttcccttactcatgaccccaggctctgccctgtctctgggcctcacacatgctgtccctgtgcctggcaggtgccccgtcactggtacaggctgtccccacccctctaggagagccttgccttagcagggtacatgccctgcaccttcttctctccacgaatttttattctctatccctggactgtgctcatttctttccaaacacctaacaaatttgtaattatgtgattttttgtttactttttaaatgactctctcccccaccgggatgcaagttccacatgggtacgaactaggtctgtcttgttctccacctgacatacaacagctactctagtcacatctacaaaacagcaactgggtttgggttcctataaagtggacaactctcctttctggggaaggattgcttcataatctgagattatgttccttctactttgttggggagagtgttaagttttttttttttttcttttatgaaaggatagtaagaataaggggtattcatcaaaaatttttaaatgataacctgatataattctccaaaatgtttttaaaatttttgagtctatgatatcccagattaagcaatgttttgggagtcacagtgttgggtcctagagaggcaaagagataggtgaagatagtgacagagaagagaccggctttgcagtcagactgcagggcctgggttcaagtcccaactctgctgcttggtagctgtcaaactctgagcgagttgcttaaactctctgtgccttagtttcctcatctgtaaaataaagataataatagaacctgtttcagaggactttataagaattaagtgaattaatacttgtaaagttaataaaacagtgcctggcctatagacaatgcttgacaaacattactgctatcattattatctattattattattattgctattgttattattactaaacccaggtctcctaaatccccaaccaggactcttttccctttaaaatgttatctcccagcattgtctctttaaatgttatctggccactcttaaatgtaagactgaaattcagcacttggaaaactatcccactccagccaagcacattttttgaatagctaaacactaaccctgataaaatgtatccatttaggatagaaatgtttctacaatatgttacatcttgtctactttctaactgggttttttgagatgagtatcattacagaaattatctgctgtgcagcctggaaacagcaaaaggaaaactcagcacgttctacagacgtgggttcaaagccctgctctgtcctccctccaagccctaaacccctcctgagtttcagtttccttactgaagaagtgggaaggccatgtgcattgagaggttactgtggttttgagtccagtgaatacacacactgctaaatcctaaaactcttctttcttttttggttaataatattaaactcatccaggagaataccttaatttaagactccaggcagaattctcctttccccaagctctgccaacacccaaacccctccccagaagacagcctggttcacacaacagaggaacagacccctcacgactctgcagggggaattcctttctgggagagaacacatgtccaatagggccagtccccactcaggctgctgctgtcactcagccagaaggcaggacaggcttttgaagctgtgatatttctgagtttggttttggacaaaaacaccattcttcctcatagcctttcacaccctgattcaagcaattttaactgaattctatttcccttcaatagaaggctatttgaagatacaaaaaccatatttgtgaatgaattctaggattgtatttgcagagtcactcctgttggatttcgtgctctataccaagtgtatttctacctctgggcctcagaaccatttctcacaccccccaacaatatctcatgccctcatatcccaaatatgcaattacctatcagttgtgaaaggtaaaaataaaattcatatgggtttcataggtcaatggttcatgttaaaggagacccatattaaataatattattaagtagatatttataaggctaagaataaaaggtggggaaatgggtgggattcatcttatctttctaatgttcattacctagaacctggaaaccaaatcaatgaattttctgactacagactcaacaaatatcatttgtttttaatgataatcagataatttaaatcagataatctaaatcaggtaatttagaaatatctgatttctaaactagtcctggactacacttacaaagaaacagcactgctatagagaaaggatgaagacataaattggagacaggaaacaggaccagattcagaacactattcctgcatatgagatttaaagaaatatacatacataattttacaactcctacaaagcctaattttatttgtaaaatataccagggtatcttagcaagtttctttggaaccacgcaactaagagtgctttttaattaattgcacatctagcaatccacaaatacgaattaagcaccatgagttggcactgaggagaatttaggtctgttctcccacagagcaagcaatttgcgaaactttgctctaaaacacataaaaaccctggccttagctaccaattttaaggatgttctattctgcaagggttcatcttcattctctccaaaaggatatgagggtcctgctgtatttcaatggaaccagacccccaaggctcagaaatcaatcatttcacaagaaaaaaagggtaagattatatctaaacatttcattagcataaatctgaatgtgtgatatttggtcattttgtcttagtttacaaccacctttgcaagtgataaaatatagattgatggtggggagagggtaggagaagaaaacaccacactcacatcacgggatctaaattccaccagcaggggtgggagctgaactggcctaacctgaatgtatgtacaaaagaattccttccttcctctctccctcccttccctcctccctcctcctccctctctttctaactccctcccttccttcctctccttcccccctccctccctctcttcctccctcctcctccctctcttcctaactccctacctttcttcctccccttccctctcttcttccctcccttccttcctccccatctcctgccctctcttcttccctccctccctccctcccctccttccttttttttcctacctttcctttccatcaacaagcccaggtgatggcagggataccgcatactccacttgtctcttccacggctggggatggctctatcagcacttgccccatttttaggttttacttcccaggtcatcccagatttataatccatgcataatgcaggcacctaagcacttctgggcccctactagaaatccagaggcgaacaaggcccagtgcctgcctgttctcaagtctccatgcaatgggcaccctagcggaaagaacacactctgagattaatctggcattgcaggggacttgcaggacctgttccaggtgcctgacattatctatctagaagaggtctccctttcagcacagttattgcctacatgaaggtggcctctctcaactgcacaggatgtgccattcgccaaggaatactaggcatccctccatcgtccagacagatctcaagtgagatgctcaatccctataagggttggtttcccctcagtggattacaacactcagatcccaactttccactgcacaggataccttgcagccatttggttttgaatgaccttctcttcccctcttcctgaaaatataagtttccttattgaagccaattaaagccaattctgctttaacatattctggagcacttcacagcatgctttaaattaagcaggaacaccctggtctagtggtactgcctccaaggcagtcctcccttcatctccctgcctccagccaataccctgcttctctgtctcctcagtccacctctgcctgctctgtccctggtttcctccacctagaaaagtgcatccaactgattttaagtacctctgacttaggggtaccacactgtgaaacctctgcttctatttcctcttctataccttgcattgcaagaaaatctaggctttttattcattttttagaaaaattagggaagtcacagcctaggtagttactagaagaaacaggcaaggccaagaaaaatagccaactcacatagagctcttcttaggtgcctagcatggtcttaagtgctttatagatactgaccattaaacctcaccacagtcctatgatgtagatattattagtgtgcccattttacagatcatgagcatgaagcccaaagaggctaattagcttgcctgggatcatcctctcttttttcttttttctgagatgggtctcactctgttgctcaagctggagtgtagtggcgtgatcatagcccactgtagccttcacctctcagtctcaagcgatcctcctacctcagcctcttgagtagctgggaccataggcatgccaccatgcccaagtagagatgggggtctccctatgttgcccaggctggtcccgaactcctaggctcaagcaatgcccccacctcagcctcccgaagtgctgggagattacaggagtgagccaccatgcctggcccatcctcttaataaatggtagggctgagatttgaacctaggggcctgactcaggagtgagtactgcttaccaggaagggaatgtggtcagcatgacaacaaaggcatctctgtcctccttaaatgcagcaccaactctgtaaacacacagcaggagctctagatacaccacgtttgtacacatttactgagtctacatttccatgtcaccttcaggaagagtggattggcttgggtgaggagaaggaagaagagcggagacttccgcccttgagagattctattttaatttttaagaaaacactgaacagaccaagccctggatttcaagatcagttttcgaggtctccagacatgaggcagtcatctgaaaaggaagacatgacagaggagtctgacctctgtgtggcctccttgctctccctgcactgccttcagatctcccagtgaataggaaaggaggggagacctgcatctgtggggcgagcatcccctaatcctgataggcttcaaaaggttgcgaaaggggccacattctctagtactaagacaatggcattaaatctaaatttcttgataaccaaactaaggcataaaggccagttaactatgtctagttctaatataacactctggaacatgccctgtgttatcttagcctagcttcctagaaatactgaatcgcaatattccacaatgcaagttcctcccactaaaggcctctttggagaaaggagttggctgtgacaaaggctgtagtatatagaggatgatcgttatggtggtgatgacaacagtgctgatagattagacaatagcaacaatgaccatgagggcaacgaagaccatgagttgtgcaacatctaatacaggtcaggggtgaatacttttgtgctgactgcttttcaagcattattatgttatatcttcacaacaatgatgagaggtgggtatcagcacaatgccccctttgaagatgaggaggagttagatgagaaaggccaagtctctggggcaagttgccataatttgggtcataacatgaacccaggccaatctgactccaaaatttcacattcttatccactgctcatctctctcttcctattagaaaaccttattatagaaagttctaaaaacgatatgctgattagtcaaattttctggtaaatacatagtaatcagttccaaatactcaattgaaaaaaattgccaaaatgttcatggtccccagtcctgccttagtaaatatagcacactaaatataaatctagttctactttattaatagacacatgatggactatctcccagctatttgccagaacaatctgttcttattgtagagtatttcagatgtaggtacagcattgagaaggaccatacactcagcccagggcatgctctgaaactacggtattaaacattaaaatctttttaaaaatgtgttttattatttgcctttttcttacaaaacttcagtccaaattatttgggttgataagtagaagtttcactgtagtaaactgtaccaatggctgcctgtggtatgtccagagtgtaagagagttgatgagaaacaacaaaagaaacaaacaaaaacttgaaaatataacaaaacttggcataaaaattaaaatgaccagccccctgatcctaaggaaagtccattttctcataggggcagtcagtatatttttatcttgtggcttaatgtttttgtagacacattaaatcataaaaatccaagaaaccatatctcactcccaaaccacacaatgtattttaaggaatatgtcccttttctaagaaactgcttgattttcaggaagtggtaaagtggcaggtgtgttcccatgatcagccagagaaaccaaataaacgttccactgggcaaacctgtttctcacagataaacagctgcgagctgcacgcgggagggaaaaggatcgtaaagactgcccctatgtctgcctgacactttctggttttctgtttcaattgaaaaggaagatggcagcctacaactgagcagaccctactgtggccaggccaatcccagcccctgcatgggacaggagtttcaaaatcccagcactagacagaaggctgtggtcatctctcctctaggtagacctgggaagggataattaaactaggagttgcaggagaagcagatttcccatgaaaaagacatcatcacacaattaatagctaggcttgataggaaggggaaggaatgtccctttttacttacttccaaggcagcctccaccttgcttctcataccacccatcacattggaaacaatcaccagtctgtatcctcagcagactgtgagctcctggaagtcccctgggcacataacaagcactcaatcaatgagaattattgttattacagtgtgtgttcaagaaatatctgttgagtgagtggaacagaggaaggaatgaaataacttgactttccatttggaaagtgtcttgctaaatccttgctgttagagttcaggagttgggataggatttcctatactgccactttggtttgtcatgttgtaagcagggttaaaggcaaatttttaaaaatatgagacagggctgaactggctttctgtctagaaattctagattaaaataagggtctgtctaggagcggggagccagctggctatttaggaggcttggaggttaaagcgaagtctaaatggagtaagagacactattccaaggggtcccctggtcacacagaaaatacaggggcagcattcagactacccaggagtctgcaggacttggtatgaaagagcaaaaagaaaaaaatatatagacaacctaggaggtctgaggactcacagacactgactggctggggtgggactggcaggagctgctgggaaggctggggcagcttctcagtggtcctggcagtaaatactatccaggaaaagtgtgccttgcagtgagagagctgctgggaaaacggcctggacaatcagactgcagtgctgtgagctagattgcccttcccctagccaagaggtgtctcccaccacccttcccctaagcagcataagagtgaaacggggtggacagctaatgcccactgacctcctgctatggaccacaggcactctcctgcgaaatgcttgtgaggttggtgacatcaacattacactaatgacaaaactgagcctgagaactgcaactcacctgcaatggtacacctgacagcagaaccagaactttcactgaaggcttacctctccagggccaaaagagaacctgtgaccccacaggatcgagcctgccccctcaatgcctgtcagaggcagcctggtgggtgcagaatgtgatagcaagttgctgttggcacggcctgctcttctgacagctctgcaggttatttctcacaactttgctgccagcttctccctgcctgtcgctgacccctgtcccagagccacctccatctggaaacacccaccccccaactctaaagttgtaaccatacatacttaagctagaaaatttaaaaggacaaagcagaaaggaattaagaaaaaaatggagtaacctattattttacagagaaataattttaacattttggattaattccttcacatacttttcttttgagatggagtctcactctgtcacccaggctagagcagtgcagtggcgaaatcttggctcactgcaacctctgtctcctgggttcaggtgattctcgtgcctcagcctccctggtagctgggattacaggagcacaccaccatgcctggctaacttttgtatttttagtagagatggggtttcatcacgttggccaggctggtctcgaacacctggtctcaagtgatccacccaccttgacctcccaaagtcttgagattacaggtgtgagccaccacgtcatgagccccctccagtaattttctatgcatttagatgcagatactgtttgcctgtctttaaaatggtgttgcaccagactaactgtttagaggtccacttccctgctcagctgagcactgacacatgcaacctgccacctgggaggatgggcaggcattcccgaaatgccatcatggctgctgctaaccatcccgggattgcaggcaagtgcggctgatgcagaaggacgttggggaatgcggacatcaggggtttgcaaacttgtgtttctccctccactgcccatcctgccagcctcagaaggttagccatggagggtgggccaatcccaacatactcaaaaatttaaaatcctgaagggttagcattggaagggattttagaggctatccagcccaatcccctcacttgcaaatgaggaaagcagagctgagagagatttagcttgtgctgggttctaacagtggctccttgccaacctcaggctcctcctggtctaccgtctgtgcctggactctgctccagcacccccacccacccacccacctgccccacttggcagagggcagcagccagagaaggcaggcccaggtgggggacaagagtctcaggactcacctttcaaatttaaagaatctctcgttaccatcaccataactcttagcccaaccattcctcttcagatccaaggatatctaagtctgactgtggaattttgttgcggaggattggatacagctgtcaaattccaaaggcatccagtacccatgctctccacagagcagtcccttattatacaagctctgcaccagctgagaaccatgttccagtctcatattgctcagaatctcctctgagcttcacataactcaggcacaatctccctgaatcatatggcataggaaagtcatgagcagtaagacttggttcaagaaaaaataccaagttctgaccactcaaagtacccttaggtgctctcattcatgtgagctttccgtttcctgctctccagccccatttcttatttgggttagggatcccctagggctgctcagtggtagggggccactgaattcaaagcaggccactgtactcgaagtagatggctaggaaaaaaaaaagggccagtcacagtggttcatgcctataatcccagcactttgggaggctgaggcaggcagatcacttgaggtcaggagtttgagaccagcctggccaacatggggaaaccctgtctgtactaaaaatataaaaattaactgggcatggtggtgcatgcctgtagttccagctacgcggaggctgaggcatgagaatcacttgaacccaagaggcagggggtgcagtgagctgagatcacctctgcactccagcctgagtgacagagtgagactccgtcaaaaaataaaataaaatccttccttccttcctccttcccttcctccttcccttcctccttcccttccccctcctcttcccctttcccttcccccttcccttccattcccttcctttcctttcattccctccctccctcccttcttccctccttccttcctatttctgagcacttctttcccaggcacaaggtaaacgagctttcaaatatagcacactgaatacccatgataattctataaaatggatcctattcttcccattttaaagatgaagaccccaaggctcagagcagtgaggtgcagatttactgtgatgctaaggaagaaagtttcagggccctgccagcatggacccctttcaaggccctagcaatatattcttagaatcatgtaatttttaaatgaaatttgcagtagtaagatattttaactgcaattgatgaagagcactgtatctttcaactctgatgtctcctcctgatacatttcccctcatgttcatattgaatggtgttacagtagctataggtgttttgggatccagcataagggaaagttaatttggggataaatttagtttgggtgtagtgggatttatgtctattgttcacagtcacgttaatgcaaagtcaagtgattgttagctgtccccatggcttccagtgctaagctttccacaactcaatggctttgagactcaaaggtgcaatacctggcacctgagacataaaaataggggagaaaaaataggattgaaatatacagagcggtccgggtgcggtggctcacacctgtcatcccagcattttgtgacaccgaggcaggcggatcctctgaggtcgggagttcaagaccagcctgaccaacatggagaaaccctgtctctactaaaaatacaacattagttgggtgtggtggcacatgcctgtaatcctagctactcgagaggctgaagcaggagaattgcttgaacctgggaggcggaggttgtggtgagctgagatcgcgccattgcactccagcctgggcaacaagagtgaaactccatttcaaaaaaaaaaaaaaaaaaaaaaaaaagaaggaaaagaaaagaaaaaagaactatacagagccagaagctagagcatagaactttcttccagtctttggacatgtggaattgaaggaaaatttagttttcactgatgcctattcgaaaaagaaagttttctcctatcagaaatgtatttgataatataatgaatacagttataaatataccagacattttccccctttttggtgggaattacacaaaatatattttatcaaaattcctgtattgtaggacccaaacctatggcagtaaaacaaaaaaaagtggatgtctgtgtctgaagccatgttttatgcaatgtaactatcaataataaaaaataaatattgtcagtcatgctagaagaaaagctaaattttctttgcaacctccctttagaaaaattacaaaatcactatcatatgaagaggtgatcaaagtgtattcagccaaaatatattcagggaaaaaagtattatggaggtttcacaggcaaataataaaaatattttgttatttttctggattttataaagtttgtgatacatgtcaggttttaaaaacgtatattgaatgtgatttattttcttattctaaataaatattcaccatggtacctaattttgtatttgtaattttatattctttttcttaaagaggtcccccagttgcttaaacttcaagccctacaaaatctcaacccatccctggaggtgaaataactttcccagccaggaagtggcagacccaggactagagaacttggtccctgactttgggatcccctgaacttcacacatttgtgcccagtcatccatagggcagcctgggctacaagggtcagggtgctagtggagaaggtcaaaggatgatgaatttgtaaactggataccatcactgcagccagcacatgtggcttctacctcacctgagcagacagcaagaggttttctgaagacctgagtatgcaactgacaaatcccgactctgttaaaaccaagtgcccagattaaagataaatagccccaaatccccaaacaatataattgaatctggtttgattcttctgggtgtcacattccctaaacttgcactgtccaaaatggtggtcctggccacatgcggctatttaaattaataaaaatgaaatgaaataaaaaatccagtccttcagttgcagtaaccacgttttaaatacttaatagccacatgtggccagtggtttctgagtcagacagtggagatatagaatgctcccatcacacccccaccccaggctctactgttaagcccagctgaacttttttttttttttttttttgagactgagtctctgtcgcccaggctggagtgcagtggcgtgatctcagctcactgcaagctccgcctcctgggttcacgccattctcctgcctcagcctctcaagtagctgggactacaggcacccaccaccacgcccggctaatttttttttttttttttttttttgtatttttagtagagatggggtttcaacatgttagccaggatggtctcaatctcctgacttcgtaatctgcccaccttggcctcccaaagtgctcggattacaggcatgagccaccacgcccggcctagcccagctgattttaaacagtctttactaagacatatctaagcccttcttctcaagaagagtgtttgcaggtgagtgtggccgatatgtgaggagagaggagaaggaggagaaaggaaggcctatccagagagaagagagggacagcccagctgagaaggggccaaagagggggaaaaaggaaatagaacctaaagtgactgaggtgttaggccttgtagagaataagggcatcatcagatgtgagccaaggaaatgattcagatcacacctgacagaataaggaggataaattagctccagaatcagttatcacatacctcatgtaccccccaacatacacaccatatacctcacaccccccacacacataccacacacacacatgccccccacaccacatacctcacacatgcgcacccccacatacctcatacacataccaaacacacacacaccacatacctcacacatataccacacacacatgcccccataccacatacctcacacacacaccacatacctcacacacataccccacacacgtacaccatatacctcacacaccacatgccacatacacacacaaagaccacacatgccacacacacacacaaagaccacacatgccacacacacaccacataccacatacacacaccacatacctcacacgctacacacacacacacacaccacacaacacatacaccacacacaccacacatacgccacatacctcacacaccaaacacacacaagcaccacacacacaccccccacatacctcacacatcacacacacctccatatacctcacaaacacacatatctcacacacacacacaccacatacaccacacaccccacacctcacacagtcccaccccacatcccctgctacacacaaactcacacactttaaagtgtgctttgcattccaagtctttgctgggaaaccttagttgcagctttacgtggctggaatatcaaaaggcaggagttgtggagtcactgacaataacatcatccaccttctcaatgtccccgacactgccacctcattacccaaaagccactgccattccagacctacgcagagtctgaagggcagcacccccttctccttgggactggagggacaccttgcctcaactctcctgcagggcctgaggttaaactctcctgtattccaccatcaaaggacagcatgggggactctagcccttttaatgggctgccaagagcaaaaattcacgcattctagagtatgaaagcccggcagggtgggccttcatttcccatatgttagtgtgtatcgatggagagggtagggagccctgtggggaatgagggcacccattgtcccctgcagagcagttgtggatggagctcctgtaggaataacggactctgattaccacggtgacactcccaaggtgatggctctggatagggtttgcagtctcctttatactcatcactcccatctaatcctcacaagaaccctgctccccacttaatgaacaaagaagcaggcctagaaaggcaagtggcttgcccggaattaacaataatagtttaaccataataacattgccccatctgctcaccatccaatgaacaactcaagtgacagcacagtggttaagagaacagattctgaaacagatgtacctggttcaaatcctggctcggccaatgactagctttgtgccactgggcatgtgattcaattaccctgtgcctcagtttccttgtctgtaaaatggggatgatgatagtccctacctcatgggttgctgtgtggtttaaataaattttcacatgtaaattacttagaaccaagcctggaatgctcagtcagcactccttaagtgctggctgctttggtgcaggctctgagcacagagacaaccaaacatagcacctgcctccaaggtacttacagcctaaagggagaaacagaaaagtgaacaagagctagggtagaaaagatgctcggggcacaaatgagggacctggaatccaggaagggcctgattcctgggccaagtgacaactgggttgagttctgaagagccacagtacaggcactgtgacagcccttatttatgttttccagcttttattgtagattcatgtgcaggtttgttacctgggattattgtgtgatgctgaggtttgggagatgaatgatccatggccctttttatatagtttgtcatttaatccttggaccattttacaaatgaggagcctgaggctcagagaagttaagcagcttcccccggaaaaccaacttggtaagtggtggagctgggattcaagcccacatttgtctgattccagaatcttactccaagtctgggcaaggcgtgggctggccaggcagctgcctgaagggcaattgtctataaccctggggtcagggggatgagaaatgtgaggcctgttaacccaggtctctgggcaagcttccttatataacctgcacattgtcaacgctccactcaggcagctctcccattccttactacataattattagataatgcataagggagaggtttgaatgactagcctgcctgggaggctgcctctctacggtcctgcttccaccacacgggagccctgaaacgagcaggccagctggagaggtggccaacacattcctcacccagaggctccgggctccccagatggccactgccacctgaccacacagagtcactttgccagaaggactgccctgctttaggcctgatctgatctttttccaggaaactcgtctggtgtaagatttatgtgtccaaacttgccagccttcccctttcaccctggactaacagggacaagaattctaatcaatgtgcaggaacacagaaaaaaaacagggaaacagcaggcaggcccaaccccaaaagccccaaacttatttcccaattttgggttgcacatgtatttctactcacataagacagtttgcatccaactggggggaattttgagtttcaattaaactttgctaaaatacaaaactcatttccccttaactgtgcttcctgacaatgaagtggtggtgtcacggggcagaagggctgatggtgtgggttaccacagcaaggtccatgctgcaaagacgggctgcccctcctgctctgggagtcaacgcttcctgggtccaccaggcccagcatttccacaggctgtcatcggtgtgtccccagcacagcacctagctagatctcagcaaatgatttgaatgtgtggggctccctccaggtaagaaaggaacccctgctcacggcactccccagaagtccttggtaactcactttctctttctgttctgaacatccattcgggctggtttaaagcacagctcgctcaagaggcagccctccagaggagatcggggttaattacgtttactgacagctgtcttctttctcctacagtcacttcttcccatgtcctgatttcattgcttgtgaaaagagatggccttccaatgggaaaaggcaaggagtaaaactcacgagagaaagcgtcctggagattttaaggagaaaggcacatcggttctgccagcacaagagctgcctgtttccctatcagatatcaacactcatttagtgcaagggtgaatatcacctttctattgaaaagaaatagagtaccctaggaaaatagcttgcatcaaaacaagagaaaagtaggttctgaaccagaactaaaatatttggacaccgaagctgtgactactgatgcaaagccattaacccataaaaacaaacattcaaacaagacactgcatagctctctttaaatgagtccaaacaccagagctttatcttaaaacaaataaacaacaacaacaaaaaattcctttccccatcccatctccacccacccactaggagtaaaacatattgctagctctgagacttttctaagaacttggtcagagacactgagcggctggtcaatatatttcttacaaatggggctttgagagcggaactagcagctgggtgccaagaacacagtggctctgctcacatctcacatatgcccagacgctctgaaccacagcctaccactgctgccacaggttcaagttctgaaacccaaagagagcacagagaaggcaggaagagaagaaaaaaagacccagatgttgcaaatcagaataagtgctgagtgaggcagtatcatgacatggcaacgataaatgttgaacgttggctctcctcttgtcagctgacccctctgctctgggacccttcacactgtgactccagttaaatcaaccagctgtgcctccaagaaaggcagcatgggtcagtgtggctgcctggactctgctgctgacagctgcagagagaaactcaaaccagccacatagcctggcccaccttatagtctgaacgtgcccagccaaaaagaagaaaagaaaacagctcaaaaaacagcaaaggctgggtacggtggctcatgcctgtaatcccagaactttgggaggttgaggcgagcagattgcttgagctcaggagttcaagaccagccagggcaacatggtgaaaccctatctctaaaaaaaaaaatgcaaaaattagctaggggtggtggcacacatctgtagtcccagctactcgggaggctgaggcaggaggacagctagtgcccgcaaggttgaggctgtagcgagccatgttcgtgcaactgcactctagcgtgggtgacaaagcaagatctcgtctcaaaaaaaaaaaaaaaaaaaacagaaaagcaaaaaacccacagctgagaagcctctggctcaaacccacatacagaagcttgtcggctgctgtgtgtacacataccagccaccatgatcctggccttctctgaccattggtctgtaaggaaataaggtgataagtgggaactgggctctgaaccctggaactgagaagtcaggctgctgcaaaactctccaggatattaatccctctctctgcccagtggttttcaactgggggcagtttagcccccctagggaacactcatcaatgtctgaagacatttttggttgtcacatctgggggtcagggggttgctatcgctacctagtgggccctggtagaggccaggtttgctactatacctcctacaatgcccaggacagctctcacaacaaggaatcatctggcccaaaatgtcaatggtgccaaggctgagaaaccctgctctagagcctaagagtgctgggctcaaattctaacatcactgctgactagcccaggggcctttgtataacttacttcacctgtcagagcctcaggtttatatatatgtgtgtgtgtatgtgtttgtgtgtgtgtatatagatatacatatatatttatattcatatatacatatttttatatattatatatttatatattaaatatgcatatttatatataatacattatataacatataatatatattatatatgaatatgaaaaaattatatattatatattatatatgaatatgcatatataatatttattttttatatatatatatataaattgtctttctgagacgaagtctcactctgttgcacaggccagagtgcagtggcatgatctcagctcactgcaacctccacctactgggttcaagtgattctcctgcctcaacctcctgagtagctaggattacagacactcgccaccacaccaagtgcagggattacaggcatgagccaccatgcccagcctattttatatatttaacaaaacttatgtagcagtttctaagtaccaggcactattcaaagcagttcatacatattaactcatttaatcttcctaatcaccctatgctgtagtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagcacgctgcaagagctcccttcctggccactttgcagaagagaaactaaccttgcgcagcaagtcaggaccctcccccacaaccaccccccagaaaacacaacagtctcacaagttttagtatggtcgcgtctgtaagcaaaagtaaggaagtcataagataagccccacgctggaaaacttgatccttttatgaaaggatggacaggctcactgattcaggtgagaaagaagcccaagtcctgagaggtgcagctgctgaagaccagggtggccccaagcaggctatgtgcaggctcccctgtcctctacctctcagtgaaggatgtccaggagatcccactcctttccccatgaacccagttcccttccatctgcccactttggtctccctgcacataaactcatctccccctacacactccacgtggtctggccccagccttcattccacccattttagtagactgcttccacaatgggctgttcagatccagggggtccaatgttcatatcagggcttcaaatgacctaacattaccagaggcaaaggtgcttaggttaaccaaaaagcaggaccagactgttggcaacccagtgtgctaatgcaggccacccaggccaatcagaagtactgaccagagaaaggcacatttcagactaaataaatatttatcttttttgaaattacttaaagattgcaatttgtttagaggtgtaactggaccccccgcaggcccaagggaaggctgttctagctaacggtaaggagaggagtagaaggcaaggtggaggagggccttctgaggcaggaagtgaggcatcaggacagggtgtggctgggaacatcccccaggaacacatcaagtgactgataaacatttatttgctttatattaggagaatgagaacacggcctatagaaaactgggagtgctaagggcaaagaaacggcttaaagacagagagactatgtttgagcaaagtgagaaaggccattcattggtaccctcagttattaaaataatatataattcaccgctaatcacggcactgcccggatgaatattaattgaatattatatacaacatattacacactgagtgactcatagttacttctaatgaatatcaatatattttgacacatttaacaacgtggagtggtggagggggtacttctagagccaggcttcctaggtgcgattcccagctctgccacttactagctctgtgacatgtggcgaatccctggacctttctatgcagcagttttccactctgtaaaatgggaataaaaacaatgtctaccacaaagtaaaactctcaatacatagtagcttttgttttttaaaaagcttcaggattcaagttgatgagtgaaatgtatgggcatcaaccagattatgagcattcctcttcttcagaagttagtgctgaattatctggtccttccttaaccactgtgaacttgcgtggtgtccaaagacagaacctttcctgtcaacacatgtggaggcaactgcattaggtgcccggcccactgcttttctgactgccacttggccagagctgaaattctactcaagtctgtgagtgaggcccagctcctttccaagttccttgtaatcccactcaaaaaggcatgctttttacttttcttttctttttttttttttttgagacggagtgtcactctgtggcccaggctagagtgcaatggtgcgatctcgggtcaccgcaacctctgcctcccgggttcaagcgattctcctgcctcagcctcctgagtagctgagaccacaagtgcgtgccaccacacccggctaattttttgtatttttagtagagatagggtttcaccatggtagccaggatagtctcaatctcctgacctcgtgatctgccttccttggtctcccaaagtgctaggattacagttgtgagccactgcgcctggccaaggcatgctttttaatgaactccagttctcctgtctcaaagaggtctatcacatggtctttggaaagaagtggtccctgctgtgacagaggatcctgacagcagtcatggagcgctcgttaaagaaaaaaatgattcaatggcgcttgctaacgaactatagggcaagctttatttagggaaaccaccaagattggtgtagggaccaccacagtggtgttttgcagtcagggagagagattgggatcaactccaaatacaaggaaaagtgggaatgcatagccaacgagaatggtgaaggtcagtggatggaaaattactgcagaaacatcagaggtaaggggggattctggctaaattggcctaacaggattcttgctgaaggcaggcaggttgaacagacatcacctggggcacggtagaggatgatgctatggtctgaatgttggtgtccccctaaaattcttatgttggaacctaataccagtgtgatagaatgaagaggtggagcctataggaagtgatgaggtcatgagggctgggattagtgtcctcataaaaaaggttgaagaaagcgtccctacccctccaccatctgaggacacgtagaaggcatcttttctgaagaacaggccctcgtcaacactgaatctgctggtgccttgaccttggactgcccagccgccagaatagtgagcagtacataaattacccattctaaggtattttgctatagcagcaggaacagcgtaagacagatgaggaacccaatcagatatcaagggtgatcagatattgaggatggaggattctgtctaaactggattcgtgctacagttggacagagacaaacacagaagctcaaaagttgacccctagttgaaaaaaatctcagaagagcctaacgtgtggtcatggagagaatctttgtcaggccccagatcaaggacagcatgtggtgggtgagatccacactcttagggagaggagatgctttgaatgacctaattctttattgctgggagaaggaggacccagggtagaaggaaagacctgagagagagggagagagagagagagagagagagagagagagagagagagagaggtgctgggagaaggaggacccagggtggagggaaagggcagaccagagcctcagagcctgccatccccactggcatcattttgctctcacagggcccctgcactctgcacaataaaggagttgtttaacctcccagcatcctgggggcaggaaatattggtttcatctatttgttgtttgtttcagtcttggtgcatcttggaaccaaagttctcactgtatggacacaaaactaatttaggttcttttaatccaacataagaaaaacttagtttcctctagccaccatcaatcaacacaaagccaacagggcggaagggagggcccttgcttcctggcagtctccctggagggggagggggcaggaagtgatctagaatccagtctcagaagaactgctgacaacaccctcaccaaaacgcatcatcatcttgcactcatctctaagtagtgcctcccacagcctaagagcaaaggctcataacttctatccacagggtttctgccatttaccattacctccctgtcctggctcaggcaaggaccctcagggctgagatgcatcttcaggtcagcctgcccacatgtaaacagatgatacatgcacacgtgcgtgcacacacacccacctctgcatgctggagatacacaggacgtggaataagtcctctctgagaatttacgaaggcacctggctgccatcagcacagagtcatcctctgtctgagttctgaaggtagcagtgtctctgcaggtaggaagagagacaaatggagcttccttccagctgaagcaagtagaggctttgttttctctctagagggttgtaagaatttattgttttggagaaataacataaaatctaagagcgctggttcccaggctagaagacagaccagatctattcattcagcaagcattaaaaattcactgcttaattaatacaccaattgctccctccttgcaaagaggaagaacagttcagccccatgggctggcatctttgccactgaggtctgcacaagatgcggatggtgaacacatgctacggccattttggatgtttccttgtagcatcaatgaggaaagaaaacaaaactgttaaaaataaaacctctgccactatatcctgaattatatcagcaagctcctttttaacaagatgttatgtccaggaaatgtatccatttactgattgttcctgaagaaataacttgttcactaggaaataacttaaaccagaaatgtgggctctcatctgatgtggtttatgcatctctaggtgttttcagtgtctcttgtctatttaatggactcccagaagagtaggatgtctacctaaaaagaaaaattaacgtttatactctcctgatgatgtttatgtggaagaaaacaaacatttgtcaaatgtctgttttttattttatttatttatttatttagagatggagtttcgttcttgttgcccaggctggagtgcaatggtgcaatctcggctcactgcagcctctgctgcccgggtttaagcaattctcctgcctcagcctcccgagtagctgggattacaagtgcccgccactaggtccagctaattttttgtgtttttagtagagacggggtttcaccacgttggccgggctggtcttgaactcctgatgtcagctgattgtcactcatccattatacatcatttaatctgccatgagcttaataagcattatagagtctaatcacctaatgagcacgctcatgaaagtgtcaccttcattgaatcatttaactctcctagtagctctatgaagtactattattaccccccagcttataagataggaaactgaggctctgagaataatctgcccaagatcctgtaagtagtaggtctagaattcaagcccagcctgatctttctccaaatctacattattgtccctgaaccaaaacattctcaggccatgatcttctcccctgtcagcagaatctggagcatctcagggttcatgttgaattacaaagccctgccctaaagcagatttattggaagtccagtgcttgtgagagttattctgaagggaaaaaaaaataaaatacatatatatatctcagaaagccttctctgcccaggccaatgcagccagctccctgcttaagaatagctgcccatgggcagggtttcctggccagcaattcaagatgtgcctgtgccggctttactctttaatctcagtttcctcacctttaaagtgggtcccacaagccctgtcctacagggctgctataaggatttaatgtgatgagaatcctaacatagctaacaaagtgcctggtactgggtggtcagtaaatgacagttattgctgctattacttggtagactcccaaaagttattctcacatccagtggagggaagaggagggagcaatcctcccttgggggtagagtattttgcatcaacaggttttagaatttttggtgcaaggtgagagtcaaaatctaacagacttcgtttattatattattgcttttacgttctcttcagacaacgtacccccttattgcctctccctgggctgggcctctctatcccttccctctccccactccctgtgctcccacctagatctcttccaaatttcccagtagagagggaatagagaggcagtggtggtatctttcaccccacatcccagtggtgatcacagcacttcagggaaaaagaaagcagccttcacacatatgggcctccctaaaaagcttcccaggaaaaaggaaatgtgtgtggaaaggccataactgggaatgaatcatctgttaggaaggctgaaggagagggagaaaggggagtggccggaggtgaggctggagaagtaggcagggcccatcgcctggggtggtgcataccttgggaagaattttcaattatctttagttcagcaagaaattacagacatgattagggcccatgcaaacattctggaagggtcaaggcaggatgtgggggaccggtgaggaatctcctgcagcagtcaagcaatggtggcctggagagggagtggacgtcaggatggataagtggatggattcatgcactcgtccttaggaggaggaatgcacaggacttggtgacagcttaagtgtaacaggtggtggagaggagagggtgaagtccggcttctggcccaagcagcttgggggacagtggtgccccttcctaagacagggtgcatctgaagaggagagactcacaggctgaggaaggggctggggtgtgggttggtcatgcatgtgggaaggtgctgagccgagttatgcgtgtgttgagtcatctaagtggagatgctaagaagggggctgcatttacaatcagttcttccaaagaggggtccagatgagatgcatggaaactaacaccaggggacgtgacaccttcacctaggggaagactacattgtaagaagagaaatcctcagacagagtctagggagctgcgatcctcaatagccaagcagaggggtggtggaggcagcagagaaggctatgcaggagaagcctgaaaagcagagagaaaaccaggagaggctggtgcctcagaagcccagggaagaaaacaagatgcagagttttaaacttcacaaaatgccactcagagggcaagaaagacaaagttaggacaatgtcactggcatttattaagacgcaggtcagaggtgctcttttcaggagcaggtgtggctgggcatgcaagggctgaagcggaggagggaggtgacaccatgcacacagcccaggaggctgcctcactcacaccccacttgcttagccccactcacttagcctatttccttcacagccattatcttaatgtgtgctgtcttgcttctttgtttacttgtgaattgccttcttcccttaaggtctgttagggcgagctccttgtctgctctattcacagctgtaccccagcacctaggaggatgcttgacacagaacagggattcaatacctgttgggtattgaatgaatgaaacagaagcagagtaaagtctggctaagaagtgaggagggggagagctgcaaagcccagaaactacccacaagaatgagccagtggtgaggaggaggggtgggttactgtccctgggaagtgggacccccagtttaagtggaggcttagggcagaatcctggacactaaaaggaatgcttaaaagggaatttgaggcattttctggtctgaaagacatccggcccacattgctttcacttaggtcatgttcccccaaaggaaatcctgagataaggattcctagatgagtgattcattgaagaaatgtccccagagtggtcggtaggagagtggagaagcaggacagaaaggggagaggccaagccaagcatgacctcaggccacatcccagcctcagcctgaccccagggagggtcctggaatgtaaaccgaacctcctgcaagtttgtacacccccaccccccactgccagggcaaggtggctgacctttcatattcccaccctaattaatattggctacagactgtcatggccaggacagaaactcccagccactccaactctcttggcaagagggtaatcctttgaagaaggcgatggggcaaagctttagaaacagaggctacagaagctgcaggatgggcacacagaagtggccgaagtgatccaacgccatctgagcagagcgccggcaatgtctgctactaaattgggatagagttttttatggattaccctggaagagcacaccaaacaaaccacttcattctgagggcctggacggtgcagggatagctaccatttagaatcgtttcagtttctattccggtaaagaatccttcaaagaaagacatcgaggctcttacagtgcagagaggtgctcttcttggacaactatagggtgtgaacgtagcacagctactaaaagtgaatgtgacacaacaattaagagagtatggtgagtatttagaaatacttagaagtcaaagcataaaaaactggataacttgggttacattcctgagacatgtttattattatcacagtactgtgatattgtagaatctggagaaataaaatcaattgaaataaaataaaatacatctaccaactaccatttactgaacacctgctatggatccaactctgtgctagaaatgaagcagcatctcccttgctcaaagctgattttcaggctgggaactagatggggctcctgaagcaattcaagaacaaggcaaaaacagatctatggaggtcacataggatgatgattaagagttgagccaggctcagcaactgcctaggatcactcccatttctgctgccagactctctgtgcctcagtttccccatctgaaaaattgagatactaagagtctttacttcacaagattcctgtgaaggtaacaggaggtgatgtgtgcaaggtccttagtatggtgctgatgaatgcagtgagcactgaggccttgttattctgcaattattactggaggtgaggctagaaaagaccacacttgcccgacttgtcctacctttctctcctcaggagggaccaagacatttatgcctggttatgaggtgacattagaaaagaaatcaaaaagcatctgtccttgtttcttgaagccagatgcaaccaagctaagcctgaaccaagagttgatgggcagctgggtggtgtgctcctctgttgagctggccaggagctaaggctgatggctttctgtccagggagccgtttagactcagagtacacacatgcttgcctcttaaaagagtattgggtcagcaaggatgcactgggaaagccatcagcatctttgcatccctactgaccatttcctgcccagcacactggagccagtgctgaccattttcctttttttttctttttttttttttttgagacagtctctttctgtcacccaggctagagtgcagtgatacaatcttggctcactgcagccacctcctgggttcaagtgactctcatgcctcagcctcctgagtagctgggattacaggcatgtgccaccatgcccagctaatttttacatttttagtagagatggggtattgctacgttgcccaggctaatctcgaactcatggcctcaagtgatctgcctacctcggcctcccaaagtcttgggattacaggcctgagccaccgtgcctggtcctgaccattttctgattggcagcagcaggagggccccagggtcaaacaatgcagtcacacaggcctgtgctttaactgtgcctccccacacagcttggtgaccccgggccagtgactttgacctctgaagcctcaattcccttgactgtaaaagaggtcctgaccttggctgcacattaaaatcactgggggagtgtttaaaagtccaaatacccagggcttgcccagaccaacaaaatcagaaccccctgatgagacctactgctgtaaggtaaaatggtcatcttctactcccagaagtggaattaagggagactatccatggaaggtgcttaccgccatgctttacacagagtgcgccgtaaaaggaggccgtgatatggtaccatttggagttcccagactctagaaacacctcccacaggcccacagaggattgtacttgaaacttcattcattgtactttatgccccactttggtgagtatcaaagatcaattgtgcattttgatttctctagttcttttgatcaccctggtccacaatcatgttattcttcaagagagaaaatggccagacccaggaagtgcttctctggattaagggctgtgaggttaaatctttgtttccatctctgccctcaaggacctccaatcccccatcctaataagagagctgccatccacaagggtccttggcccttggcttgcagaagcgggatgagcatctacaaccctggctgtgatgaaggctgccctgacagttacattcttgatagagttgcaggacaaatatttctgaacctgtggttcctttgccgtgtctctagtcaacatagggcttttagccctgtggaacatgaagatttttgtgaactagggtataaggatttaagagtgtaggtggggcctctctaggccctgcttcctacatagttgatgtgtctggacccacaactgagagaaggaacaaagcaaacaggtgggatcccttatagtttatagttatgtttttcagagtaacagacattcagggaaacagaaacagaactttagctcaagcagcaggagggggcagccagcatctgagctggaagaagagctagcaggtgacaaaggaaacaagcactctccatgcagtgttaaggcagtgcttatcatccagtgggaactggggtgccagggtgccaggcaacagagcagttgatggagacagttccagtgccattatgagctgttaaaaggggatctgacgtgtgcattccagaccctgatactacttcttgtccagtcattcaacaacatagtattccctataggcccagcatgtctgtctatgtatctgatttcacaatcccatgacataggtactgttatcctcactttgcagctgaggagactgaggcacatagaggttaagtaacttgtccaagatcacacagttagtatatgacagagttgggatttgaaccctgtgctcttaatttctatgccaaattgtctctagcttagtgagggtgtcaaacaggtcaacagacaattagaatatagtacagtctaagtgactgctagggactagcacaggtggtggcatccaaaatcccattcttatctgatgctcactcataggaagaaaaacagaagtacccacctggtgacaggctagcaggcacaaggatagacagaatgtgcacctgaaggagttcacctaggagagctgaggaggcacaaagacctgcatgtgagtgttcgtggcagcttcatttacaatagcccaaatctggaaacaatccaaatttctatcaacaggtggatggataaaaaatctgtggtggccaggcgcggtggctcacgcctgtaatcccagcactttaggaggccaaggcaggtggatcatgaggtcaggagtttgagaccagcctgaccaacatggtgaaaccccgtctctactaaaaataggaaaaatcagccaagcgtggtggcatgcacctgtagtccctgtaactcaggaggctgagacaggagaatcacttgaacctgggaggtggaggttgcagtgagctgagatcgcaccactgcactccagcctgggcaacacagcaagactctgtctgaaaaaaaaaaaatcctgtggcatatccagacaatggaataccattcagccacacaaataatgaattgctgatctacacaacatggatgaatctcaaaagcaccatgctaagagaaagaagccagaagcaaaaagggtgcatattttatgattttagctatatgaaattctaggaaaggcaaaactctggttttagaaaacagagttttgcaaggggatgggggtaggagggacgaactaagtgtgacaggcatgaagaaactttacgggatgacgggaatgttctatattttgatggtggtgatggctacactggtgcagatacttgtcaaactcattaaattgtacacttcaaaaggtgaattttattacatgtaaattatactcaatttagaaaatattttaacaagagacttgatgtcatgcagtcaaaagtgaactgtgctatgctctgaagctaacggtgagagttacatacgttctgcttcctttgttttttgttccttgttctttctttccccctttccttttttttttttttctctctctctctctccctcctttctgtctctcctcaaagtctaccacctccttttccaagccaagcctaggtgacaggcccctgagctgcaagtgtttccagcactgccattacaaattagtggaaatgatcagacccccaggcagactggttctcagcctgcttcagaggggcagatgttctgcaaaaccagccagtgacccacagagaagactggcaagcccgcaaggctctcattggacccctctgtggcttctgcctcccaggtagaaagcatgcatatattagatttaaaaagaggaagtgcctttccaaaaactactcggctttgggagggatagaggtcatttgtctttgtccaagaaaaacatgttccttccttgtaatccttgataacccctgaattgttttctccaagatagttagggacaggggtaggggagaggggctacagtaaaagagaaaaggaggtagagaggacagaggaagccaatgccctactactctgcggtagcagcaaggtgagctcttaccaccttgaactctgggaaagatggtaaaagagggaacccttcaccaaccagtgcccacatgactacctaagacagcacccatatgaggtgcaaccatatgaaggttcacttctcgctggatgagaagtgaacagagaggttaacagggcaaagaagcagcagtaatgggaaaagaacgtgagactggcacggttccctcccctgggcctgcgggaggcccatggcagccagaatgtccatctgctgtgccccaccactagtaggctcacaggaagggaagagaacaatgacaacccaactgtcccttgcgcagaagttacaccaagaagtgagcagcaggacccgctggcctggcagtaaaccacatcagagttatcagtcggaaacctcttggacaaagagagtttataaagtcccttggccaagaggcatggaagttgagttcagccaagcgcaactcagacacatgggcaatggaaggggagctggggatgccagctgccatccaagtcctgtttgttggaaattgagagagatagtattggagaactagatgctttcactttatttctccaaaagagagctggtctccaggtggtgaagcctataattctataaaaactggagattggagagataggagggtacaactctggcccaagacagaaataagcaaaaacaaaacaaaacaaaacaaaaaaataggcatccataagagaaaaaagtgagtggttctgggcatctagtaagtggaagaggaaagagaccatctctaatcctaactcactctgttccaggtttggaataaaagctgtatcgggagaaataacctgttaaagtagaattgtcaatgtgtagaactgaaaatcggccaaaaatccatcagctttctcaatttactaagaaagaataattaactccctagtacctgatatacttttgcatttaaaggctaaactacctatatctactcaatatcattcacttctagtaagactcttattggcaggtttaaagcacccctacccaacccactagcaccaacttgtcttttatcttagcctggaaagaacatgtatgggttacattactaagaacatagtatcattgaatgaatcattaaatagaccagtcactgtaataaatacatgtggatatatacattctgttaatagacttggcatagtctttcatggtttcaagtgttaaggtttattgtggtattaaagaaaaccttatagactttcattttctgaacgatagtggattcaatatatagccaactctactgaaaacactaagcaaactggatactatagaaaaactcttttgaaatgactgatgagctggcaagttagtaagacgtattcagtgagcaaaaactaagcaaaatctgaagcctagtataagagccaatccctgaagctagcttgaagacaatagccaacaaagtgaccttcacttttatcttttgtggcctcacgggaagaggagacaggataagaatttcccataacataaaggatactatcacatggatccaggaactccaatgaataccaagtatgagaaataaaaataaatatatacctagatacgctttgtgaaactatagaacaccaaacaatttaaaggaaccagaaggaaaacacagattattctcaaaggagacactcttgtctgtagacaagacagtagattttagaggcaacaatggaaacagaggacagttgaataatatcttcattgtgttggagagaaaataactggcaacctagaattctaccctaattctacccagtaaaaacctctctcaaaaacaaggggaaaaatagtgtatttgcaagcaaacaaaatcaagaagttgtcaccaacagaccctcaataaagaaaattctaaaagctgtacttcaggctctattggaaaataccaaaatgaagttggtagacctacattaatattaatcagaatagacttaaagactaaaagaattactaaggaaacaagttttgcttaattataaaagattcaattcaccagaaagataaaacaattcaaacctataggtacctaataacaaaggctcaaaatatataaaacacaaactgacagaccataagaagaaacagaaaaatctacgatcatagtgggagattataatacttctctcagtaactgattgaacaagcatacaaacatcagtaatgatataaaagacttggacaacacagtgaagaagcttgatctgatagagttacatagaacactgcatctaacaatggtaggatccacagaacattatgaaaagtgaccacataccaagccttacagtaagcttcaataaatttaaaaggctgggtagcactcaaacaatatttgacaaccatgaggcaattaagttagaaattagtaacaaaaagataataagaaaaataaacaaacattcagaggattaaaaagaaacacagctttaagtcataagtcaaagaataaatcatagtgaaaattataaagtactcagaaccaaattatatacaaatattacatatcaaaatttatgaagttagagtaaatattgtatagcttacaatgctcataatggggaaaaaagcctgaaaattaaaaagccaaacacttaccttaaaaagctaagaaagaaaaatagctcaaatgtaaataagttagatggaagaaaataataaaaattagtatagacattcataaactagaaaacaaaagatggagaggatcacaaagtcaaggattagagatagtctctaataacattgagaaaattcttaaaagaccatttaacaaaattatagaaggtattacaaatgaaaagtggacataaccacagatcccacagaacattaaaaaataacagcatcttataagtagcttcaaggtaaaaattttgaaaactcagataatatggataaatttctagaaaaatctaatttaccaatattgatttaagaaaaaaattaaaacctgaatacccatgatctattgaagaaattgaatcagaggttaaaaatcttcaggaaagaaagaactccagcctcacagaatctttttttgagaacagataaagaggaaatattctataacttactttacaaattcagcaaaaccatgatacaaaaccctgccaaggataagataagaagtgcaaattacagtacaacacactcatgaagatagatataaaacttctaaattttattagcaaaaaaacctagcaatgtataagaaatgaacccattacaaccaagtcaggtttattctaggaaagcaaggttaagttaacattggaaaattagtttaccagatattaacaaattaaagaaaaaaattatataaatctcaataaatgcagaggaagtatttaataaacatccatgtatataatttgaaagaaaaaaagctctttgcaaactacagaacaggagtagttccttatcctaataaggaatatcaaatccataaaaactctcattctcaagggaaaacgttgaacatgaaaggcaaagcttaaacgtttagaagaccatacaagaactgtccttaaggatgtcctttaaaagacacaaaatgttcaatgataaaggaaagattgataaattttattacattgaaattaagaatttctgccactgtaaagatactaaaaaagatggtgagaaaaaataacacaaataaggagaaggtattttggcaacacagagaaatagtctcctgcatatataaagaactcctacaaataaataagagagatgtaaactacccaattttcaaataaatgggcaaaaggcttaaagaggtacttcacaaaaaaagaaaatccaaaaggtcaacagcgtatgaaaagatactgaccctctttagtaatcaaatgtatataaattgaaagcagattagatactgttacacatccacaagatgggcaaaagtttttgacaatatcctacaaaatataaagtttttgcaagattagagagcagtaggagaaattgcagctggatatagaaattggttaaacacattggaaattaatttttgattaaagtgaaactcatatgacaccatagaattctgaactatcctagcagcactgaaaatgcccatagtctgtggccagtaattttattactatgtgtattccctaagtaaacttacacacatacttagcagggaacttgaaaaaaaatgtttacagcagcactatttataatagcaaaatactggaaataagctaagtgttcattaataatagaatagacatataaactgccatatattcattcaatggaatattatggttcagcaaaatgaaaaaatttcagctacacccaacaatgtgaatgaatccaggacgaaacatttaacaaccagttggtacagagtccaatcaaatgaagtcccagccctagtgccagagctggtacccaagaccccctgccatgccaggtgtaatccctttagaaaggagtggacttggagaagtaccataggagcacctgggaaagacccaggtaagcagcaatttaccaactgatatggaaatattcccattgtttgtcaaccagtgagccttactggtgtggtgtgcatggactaaacgtgagcattaagaacaaaagaataaaacagtgtgattccatttatatgaagttcacaaacacgcataactagacaatatattgtttagggatacaaatgcaagaggataagacaataaagaaaagcataggggaataaaaggtacagaaatgtccagaagatggtaatccctgagaagagaaggaatgggatagggtggagggaggtacacaggggatgtcaaaggttcaagtaacattctttttctcaaattgactggtgagtacataagtgttagtcataatgttattctttagacctttctacacagtttgtaagcattcgtttgcatctaggggctatttcattaaagttatttcaaaagatggtcacaacacaaatttaataagaaactctcatatcaaattgctgcagttcctgccatatcttttctagttgctgggcaaagatgctctcctcaattgtaattggtgtgctcttaaacccacttaaaattctaagagcttctccccagaccactccaaaacattcttgtgagaatctttccagtgaggtacagcaaggcccaacctccagggcacattatgctctggctcatttatttgatacaatcataatcatagtgggtttttttctcaaactttgaaatcttcaaaatgagggcatggagcaaatgactacattctgcttctcttgctaagatttcaatggtgatgctctcattttaagttctttaccagacgcttcagctgtgctatgcccaattcccctcatcaagatttgctgacagtcaggggaagtttctaacactgtattaagtgtatactgagggccagggaattggggggagtttgaggggctgcacacatgtgcaattttttagcaaacccagcagatgcttgtagattcaacactttttcagttatttgtgaacaacccctaatagccacaccacatggcaatttgtcttttctctggagcacaaatgtgaactgtatgttgcaaagccacagcaaagaacaagtcacttagctagagagggagtcttctcaaagacccagtaaccccatcccaagatgccaccagggaaacagaaactctctggaggtgaaagaaacttaatttccttgagtgcaaattgaaaaggcaaataattggtagcctgtgaatagtcataggaacctcttcactctggaatggaacctgattcaggaggaagtcaagagcctatgcaaatatttctgcatttgcaaacttggggatttgccaagggcttgagatgtatccactgaaaatgtcaagcgtctactgtgtagaattttgatggaggaggatttcaaaattcttcttctatttaaatccaatcaattcatgtttatcagggcatctctgatctttttgtttttaagagacatatttgctctattgtccaggctggagtacagtgatgtgatcatagcccatggcaggctcaaactcctggactcaagagatcctcccgcctctgtctcctgagtagttagaattacaggtgtgagccaccatgtccataattttatttttattttttttaagacagggtcttgctatgtcgcccaggctgatctcaaactcctgggctcaagtgatcctcctgtgtcagcctcctgagcagctggcattacaggcatgagccactgtatccagctcctctgatcttaagatagtttcaacatctaatgctaagcctggaagtccaatgaaagactcaatagactaaaattggtgactgagattcggaggagcatatcgtgtgtttataacactgcttttattttttccatatctttctactatttgtttattagcttttctttggatctcagttattcatacataacacatgtttaaaaagttgatcctaaaccccaattcaagggtccaccgatgctcagagatctcaagatttctgagactagcttccctatacttctccctggctttgctccccaaatctgaaaggcattttcagatcacccctacttcatatttagatataaagcttccccctttatccacaagaattccagctgcacctggcatttcaaaaacacttagtaatgaggaggggagacccatcagtcatgtactcaccacttccattgttgtcctgcctcccaagcacatatttccaactgtgaaacctcccaacagggcagtcctctggatagtgtggttcagtcacttcccaccaccatgcctcacctcctctgccttccaagccctctgggacttcagggaataccttttctccatcatattacaattagatacagggaacctttggagagttctgagtatttgtgattatattcaataacctgttactgacagtttcttttagttaaagaattttttcaagtaagttaccaaaacaatgaatgtatgtacatctagaaactgagaaatactcttccatgacttttagttaggtcctcacgttttccacatatgtattgaatttttaaaatactattttaaaagggtctacatttattttcctctacttttgtttttcctcttgcctttgttttggagcaaattttaactgaacacattgtcagagggtcaggccaagtttggcactgctcgtgtatctcagccaccttccagttttcagcacgatgtctgaactgaaaaaacaccattgcttaccataagggtgtggccatgacagcttgaacaacatccgggtagtggtaagtctacatttgctacacagatgtaagaaacagatagcagtagggtctacctctcctgctccatcttttccatcaccaggtctcttccaactccagaattaaagtcatcaagttggaacaactctaagtgtgtttcctgatcataacaagacaggttgaggttcatgaatattttctttagtattaaatgttagaacataaccactaataataacagtagcatagtagttccctgataaattttgacaaaagatcataaagttctcaatttcaacagcagggctttatagttgtaatataattttgaccagtaagccaccggctatccagaaacctcacaggtgccattatcatggatagttgcagttttttctctaagaatcatgcaaaaaaaaaaaatcttttggggatacttcagaactctgtctttttaaattggatgaacaaaatataattttaacttctatggatacatgtgggtcattgtgagcatcagttactatgttataaaacagagtaccaaagatccatcaaaatacataaaatttcactgaattgcttacattaaatgctcatatcagctttagaattccatgccttgaattcttgtgccttttaaatttttttttagtttttctgttttttactcttacttcttactgatacttgataaaagagctttaataatccttgcacagtacagtatcagttgcttccaatttgctaggtgcatttgacaaactaataaccaagcctcttaaaacttgaagtaaatgcagaggcctgaaagagggtataaaatttcctccaatgatcaaaattcataaactgtagctcatggacttatgacctttctcttgatttgccatctaggtcccaactggataagtgaaattatgtaaatgtgagttccagattgttgtggtattatcctaatacctatcaactacatagcatgttactaaacgtatctcatttttcttctcaagatagttcagtggtcttggtaaggttatgatggttacacctactttacagataaggaagaaaattggtcacgggctttggccaagtctgacccagaatgctagtgctgcctgttgatacagccagtgttttccagccctgcccgcctagtgcatctgcagatttgtaaatacactttgactccacaggaaacaggatggagaacagcatgtcagggactccttgatgggcaggatggagggcaaaaaagagccttaaagacattagggaattcacagagtagggagtgagagacaagttaaatgctatccagttgtcacacagctttcttaatgttatctttcatcaaatcatgtcctagaacctgccaggacttcagactaaatgcatcttcttcttgcctgtacctttcacacactaaatgtctcaacagctcacttggcaaggacccaaaggcagcacacacttctccactccaaggagggtggctgccactaaacacaatgggcggagacagctcaacaatagtgccagttgagcacatcttgatccactgccacagagttcacagtagtagttggccctcaaagcaaacccactggggtgttgagggcaaaaaaacaatcttagccttaaggggccagactttgccatcaaattaacaaatctgcccaacagccccaggctgaggcgctcaggggtgtgacaggagggcccctgttaacaattctgtatcctgtgggtgccttaactagatggagtggagaggaagcagagagctaagtgtcacaccaccctctcctcctgcctgcaggtgtcttagttggacagctgtccaccttccttgcaaaaaactcccacaatctttaaatgcaactatgtaaagggcctccagcctctgcaagccatcacaactttaaagagcatatgtcaaacagctcagacggcatctgaggtctattcttcagccccacagtatagcccaaccccagagcacaagtgacaccctagtggacaggaactcctccctacactggctgctcagcaggaccatgaagaacagctgggacctggcctattaccttggcttcaggattcattttctgcctggaattgggaaactggaggccctgcaggggtccttctcctgggtccaactgtctccagggtgcaagaggggtgaaattaccaaatgaaagttcagataagcaattactggctgaaagagacacaggagggtcttcagatcaacactgacccagagctaataccacactgtcctcagagggacacacgatcactgacctgtattcttcacatttaagttgctagaattattcctccttgcccccactctctccctgcccccagcatacacataattacataaagacgtcttaaacaactgtagcacccaacttcttcagtctgggggagagccaggagatggtggggagctgtttgggcacacgtctgatcattacataatcacacaaacatgggctggagaacactgccatgcagatcagttcagcaaacacctcattctccctctttcctcttccctccccccgtaacacccaaaatgcacaccagagttaacaaaaccgaagcactccaggtagccagtgggcacctggctgctgtggttacaatgccaagggctaccagaaacgtcagcgtataccagaaagagggccagggtgctgctcacccagcgaccagatctgcagaccctcttcctgcaaccactgcccccgaagttcaaggaagggcctagccacagaaatattcctgacctgcaacagaaaccaaaccagctacgttaaaggaaaccaatgccgagcctccaagttcctctgcaccactgccacactcaggagtcctcagcagcctggacaatatcattagggaccattcggcaccatcagtgtttccatttaaaagatagtaaaatgtggggcataacttggaggggacactctctctgctagcagggaggcaagaatcccctatagaataggagtttggtttgggtttggttgggtcaggttgggggttgggaaatgattttgctttaggaatattttcagggggctaggattaagggggaaaaagaaagctatcccctctgtctcagcagccagcatcatacgaatctcactctcaaccaagcaggctactgcagtccgcctaaacaatccggagcagcagccaaggcagcacaagaaaacgccggtgccacggaacgcgatgcctaagccccccagccgaggctcctatggagccggccgccagtgcgcgggtgcagagcccagcagagcctgctgcaagcagcgctggagcgcacggcgcgcatagggttacagccccgccgccgccgccgccgccgccgcctgtgattgacgcgcgggggtcacttgaggctcgcgccgctccccagcaccaggccgagcagcgcgctcagcccaccgggggcactggccgccacgcgcagcccacccggccggcccctgcgtctcggcagccggacaccttgcctaagaaaggcatacacaaaatggaatcgcagctcgctattctgcttcgcggtgcggcctcaggcaaaaacacaatcacaaggtaaaatacagcgcaaggaatccatccgccgaataaaaacccagagtcccctaccttcggccttgggatggcaaactggtcctgtgttctctgacccacggatccagccccttcttcatgaattattccggccaggcaggattttgtgcatttttttcatgaacacctgtttcaagtaaggggtaaagaccttattgaaagaattgtccttaaaaaataacctgtgcatacgtatgtccatccaggcatgcatgcgtgtttgtatacacacatatgcacacggaatagccatgtacattgaagcaccaaactaggcagctggataatgggagagtcggctggttgtgagcatgctcgcgccgggaacagatccaccctctgttattcctctgaataaatataaatcacgatcagaaacccaaacagaagcatccctcttgaattcgtgctgctgaaaaacacggaat

SEQ ID NO: 1746 - DNA, 188737 bp, Homo sapiens
  source 1..188737: mol_type = genomic DNA
aagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttctctcacacatccagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatgacatgaacttggcaacttctgagaacaggaatgtctagtggtgcttctagcctaaagtgacccagtttcagataagacagtttaatccagaactcagagggagaaaagattaatattttctcctagggaaggatacccagagctaccacagctgaaatgggaataacatgcttaaaggtggatatgagatggccaaagtcccatgaggaatggcctccaggtatgatgatgaaatccagtgcaggagggaaggtctcttctcatagtatccaattgcaaaactggtcaaaattcaaccattttctcagggttattctaaaagctgttggacttgtactgcttctttggcttctctggctcttgttccagcttttgcagttacaaaatgagaaagacctcgctgtgctgtcctccattcagtgggttctggatggattgccagatgatgtgaagggctcttggtcatggctggtacctgcaaacacggagagtgcttatcaccattggactctactgtgccatttccatcatgtcaatcatggatagacatgagataaggaggatggaatcggcagtgggcaggacacaataggaagcgagggaggggagagggcaacagggtggaagggtagagagaattgcaggaagaaggagggacccaggaatggcccaacatcctcagagatgaaagattacagaaagagggcagaaggcgagagcagagaggccatgccagcttgggctggagcagtcagattcctcaccacacccttgtccctgctgtgcccatctgctgccctttctttgccttctggccctgtaggagccatcccagccccacatcccaagccctacctgtgactacccctcccctaagccctaccagagaaatgaacttacttctacccttcgtgggccgcatgcctccagctccagctcttcttggggctccagagtgtgccagtttcccttcaagcaccagtgtcctcaacctctggcatggtattggaatctgtgccttcagaacctcctttcttcccattcttcaggacgtttgtccctcgactggacaagatccagcaggagtgggcaacacaggaacaaatccgagacaccagactgagagggacaggaaggggaaacacggggcagtcctgggtgatctggaccatctggtcacctcattctagttcacgagtggacatttagataagggaaaccaaactgaatcagaactctaaactcagtgtgcagcagggtcaccagattgcttattctatggcacctgagacctttcatcaccactgatcttcacgacagatgcacgcagatatatctaccaaggacttagaaacccaagacagtttcatactttaaaaatgtgtggaaactaaccatgcacaaacttctccaattacatcagtctccccagaagcacatccaacagcactctgtcacaacttctggaagcagcctgcctccttgctaacccctcctccatgcagatgctcacctagaggagtggatgggacataataccaaggaggagagtgtgggtccagtcctagcacaggccaggaacattttctgctttagagtcacaggactgttcaccaagccaagctgaataaacatcttattgcaatatttgcacagacatgcaactacttgctgtgaccatgacagtgactggaatgtaaggatccatcagtggtagacccaaatcttttttttttttttttccaagtcttgccctgtcgcccaggctggagtgcaatggcgcaatctcggctcactgcaacctctgcctcctgggttcaagcaattctcctgcctcaccctcccgagtatctgggactacaggcatgcaccaccatgcccagctaatttttgtatttttagtagacatggggtttcaccatgttggccaggctggtctcaaactcctgaccttgggatccacccaccttggcctcctaaagtgctgggattacaggcatgagacaccacgcctggccggtagacccaaatcttaaagcacatactctactctagtggttcctaaactttagcatgcatcagaatcatttgtagactttgttaaaacacagagttttggttacactcctacggttttttaatcagtaggtctggggtggaggctgacagctagagtttctaacaagttcccaagcccagctattgctggtccagagaccacactttgagaaccactggtctaccaccaacagtgttcaatagtatcacctgtcttatatcaaaggaaccactaatgactcactcgcactcagccctgtaacctcatccaaagcagaggcacagaaaaggccaccacacacacaaagaaaaactgtttacaaaatgtttttattttaaggttaagaataaaaggagccttagggttcatataatctaactacctcacttaatataatattaattaaactaagcttagagagggtaacttgcacacagaaacaatgaaacaatcaatagaacccaaaccaggaaccccagcagcactactctcaaaatcgcaaacgtggagtcctagaaaatctcctaatttttgtcgtcattagagtcacaaggctcaagagtctgcaactggcaaattagggcttccccttctggtcctccatgccgaagcactcaggccatgccatggtcatttcttagtaaggctatgatggaagcaattcttggttccctccaagttcaactgtgagtccactgcctagaactcagaactggttttctcagaaatcccatagcacacgtggagggttcctgggagaactcttcctactaggcaccacattgttgaactgcagtgatgatagcccacaggatctaaccatcatgaagaatataatttcctaaaattccattctgagtttcaacttggacctgtgctggtccctcttcctggaaaactgctgccccagttttctcatgtcaggctccttctgtatgtttcctcttgcagagtatctcctgatcatctacccaagtagttctcactcccctcctgccagttacactgcatctcatcagccttctctacactccttatagccctagaactatataaaacatttgttcatcatctacttgctcattaccccctgaaagtaggatgtgagcttcgagagggcaggaactttacctttctgtctaccactataaccgcagcacctagaacagtgcttgggacacagcagattctctatacatatctgtctaatgaacaaatgaatgtacagaagaatgatgagagagcaccttcttcttcttcttttttttttttttttttttttttttttttttgagacagagtcttgctctgttgccaggctggcgtgtagtggcatgatgttggctcactgcaacatctgcctcctggattcaagcaattctcctgcctcagactcccaagtagctgggtctacaggcacgtgccaccacacctggctaatttttgtatttttagtagagacaaggtttcaccatgttagccaggatggtctcaatctcttgacctcgtgatctgccagcctcggcctcccaaagtgctgggattacaggcgtgaaccatcatgtccagatgagagcaccttctttcaacgtggtttccaaagttggaatttgagactttccttcctgtttctctcattttcaatagtaggagttagactactgagctttaatagaacgtggaaggagaaaaacgtgcccttaggctggtgttctcaatgacaggacagagaagaggaagttgcagggattgggggtggtgtcgatttacttctcagctctggtgtcctttcgcacagaaagcatgctggtgagtcaggtcttcctggatacagggcttgggaggcaatgaggtgtactggaatgagatgtttttgagaccaaagagttgggttcaaaccctcaaaaagtcatgtaaatctctctgagcctcatggggctggtagaaaatacccaagggatagggtgtttgtgaggatcaaggaagttaacatatgtggacactctctgtaaatagtaaaataatataagttgctattaaatgattattgataagaccacataggctctggagagatccaaataggtgaaatttctcggcatgcatctccattcagtcttgctgttttgccttccttagttctaccagcactctcagaccccaggctgctgcgtgggagccccggctcaagagcagaagccctaaggtgctggcatgggctcctcagagccccgtggggctgccagcagccacagcacagccatgagcagggcagccaacaggaagcccaggagaagaccactgtgagaggccacagagggacacagggacaccgtcatcggccctgagccaggggcaggtgtaagaaacaagccggaagccctcacttttggcccaaatgctttggataggccagaatcccagagacaggaatatcagagaagccagcttccctcttatgaccaggccctggcttcttcatgtccttagggtgggttctacactccactcccaaaagcagggcctatacttcttcccttgccaagaaggtggggtggatggtattgggatctttggatggattcccaagattggagaaggtctcctttctcagtcttcatgggctgcactgccaatttctcattgaccaaactttaatgttccaggcaacgaggctcttggctataaggtgtcctcatgttacagaaatcacctcctctgacccagttactcccaaactgtttccactcttccttaagtgataaccttaatgacaagtctcatgcaaacagtaatttcttatcctttcttccaagagttcagttcactccagcaactggctactaactacttacagctgagcacagatttcacgcagaactgtgtaaagttgtccttgggaagacaaacacagcagccagttcctgccaccaagcagcacacagtctgggtgggaacagagacttcacgtccccaccacgaatggctgtgttttagagttcattacctgaaaagaaacagggtgggaggcatgtggggaataaagtgagcaggctggaggaggtcttcttcaagaaaacagagactggcccagctctcttctggctccaaaatgctgtgtttattgggttgtctggatcagaggcaaattcttggatttctgacaatgttgctatgatgtaatgagggctagaatcttcttgaatcaggaaagtttcagggaggttctattagtctgttctcacacggctataaggacatactgagactgggtgatttataaaggaaagaggtttaattgactcgtagttctgcatggctggggaggcctcaggacatttacaatcatggtgaaaggtgaaggggaagcaaggcaccctcttcacaaggtggcaggaaggagaatgaaagcaggaggaactaccaaacaattataaaaccatcagatatttcgagaactcactatcatgagaacagcatgggggaaactgcccccacgattcaatcacctccacctgctctctcctttgacatgtggggattatggggattacaattcaagtgagattttgggtggggacacaggcaaaccatatcagaggtgttatatagtaaggagcttaaaaaacagaaggatttcaacgtgtagaaagggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctagagaagcctgtctgtaaatgatgatgaatgtgtgagctcaccaagggagaaggccagaggagctcacacatcgaggagctggctttcaagggatggggaaagaaaggcaccagagaagcagagcgaagacgtggaaaccatagagccttactaagtgtgttcactcacccggctgtacctagggccacctgttgtcctcttggatggaggcagatcggctttctctctccctctctctctccctctctctgtcccacctcctctctctctctctctctcagttctgggctgggacagggaagaacagcaggactctattacttcaggcaaattttgacagatgggccaggacctgcatacagggccacccagcaggcgctggggaagggagcctgctaaggggctgactgcagagccaggcccaggtctgaagggccacgggtgcctggtttcaggttggaaagggtttcaagttgggcagggttggcaatggagcatcccactgaaaacagaagagcctcacccccaccccactgactcctgttcgctcacccctctgagcttctgcccatgccgatccctgtgtctggagcactgctcagggctccctcttggcatattcttgctgcacttttttttttttttttttttttatactctaagttttagggtacatgtgcacattgtgcaggttagttacatatgtatacatgtgccatgctggtgcgctgcacccactaatgtgtcatctagcattaggtatatctcccaatgttatccctcccccctcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaaccgtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttcttgctgcacttttaaaacctgcttccaaactcaccttctccatgaattccctaactcttgaagtcaaaaatcgatcttttcctcccctatacactattctcacaacacttttcatacacaaaaatcagatatggctctatctcccccactggaccatagaactcctcagattagaaacggcactagggtcacaaattcaaatgctcacagagccaggcagataacataaatgggtgaagctgctggtttaggtgacatgggtggtaattgtcttggtgatggccagacaataggagtcactggaagctgtgatgaatcagaggggctggaatgattgattgattgagacagagtcttgctctgtcatacaggctggagtgcagtgatgcaatctcagctcactgcaacctttgcctctcgggttcaagtgatcctcctgcctcaccctcccaagtagctgggactacaggtgcatgccaccaaaggggcctgctgcccctcctgcccatatggagaataccagagcatgggaatgtgacctgtattaccagaactgcaattttcagggagaggccaggtatctgcattcttatatgaaattaccccatctttatgtgtcagcagcaaatccaaatttaagacaccatgttgcaagccaaataaaatgcatctgcagccagatgcaatgaaagcttgttgattgaaaagcaaatgaacaaatgaatgaaggaatagaaaagaaggagcagatgggtgggagggggaaacaggatgggtgcccaagtgtcaagatgccaagcggtgggctgggcacgctcaaggtgaccccgttgccaagctgtcagtgtgaacatcagcacggtcttgcttgttggctaaggggaagagaaaagcctatggccctgtgaacttagcaaccagcttctccaaaaacattacaatcagaagctcttgttgcagccaaaacacaggtgcagaaaacaagcgggcgttcgcacatgcacgtgcacaaggtgtgcagaagttgaaggctcagcatgccacaaattccgcactccctccaagcacaccttatgcctcatgttacagatgtcttgagggaggaagggagggacaatttagcaaattgggaggtgcagcaggggaaaaggagtcatccagccagaattctccccatctctacccagaaactccctctccttgctttgttgacggcgctgaagcttgggggaggcataagtgagcctggtgtgggactgaccctcagcctccaggaacactatcggcaggaacacagcccgtgtgggatgcctggggttgcaaaagaaaagttatttcaggttcaactgagttataatttattttttctaactgatcattactgctgcggctctataaataaccacctagggagtctgcttttctgctcccaaatcctcaaaaagcattgccaggttctctgtggtttctggcctgccaagcacacagcacatttcttttctgtgcagcccttcagggaatccttctgcagtgcatgccaaggaatctgctgagttctgcccaactcagtcctccccttcctgatccaattcctctcctccaaactggccatccagccctcctcccccattccacaagaggcccctctccctggacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccaccccaggaagggtggctgtggtttacatgaaatcaatttaagtgatttaaagaagaatgtatttcaagtacaactcagtttaaccaagtatagaaaaaaaaaaatcatgttcctgatgatgttctaaaggatgtacgtttaggccctttctaaataacatggggttttctccttaaacagaggaactagacgggaactaatattcatcaagacccactccacaccaagcaattttgtttcattttcacaacatgatgcctatgaggtatgcatcctcatgcccatcttgtagatgggagtcctgagaaaaggacttgctcaaagtcatgcagaaggaaagaggtaggggtgagactcaagcccaagtttttcccctgctacctcctattacctctctaagctagaagactggagtttcaatgtatgtttatttttctaactttcagattacttttgcagctcagaaagcaaggacaacctggatatttcaccacagttccttaacagccatataactctttggagttagcctctccaactagttaactgtgaaatctcaatcaatcaatcaatctctctctctctctctctcaccatttattacgacaatgaccataaaggctatggtcattcaggttgctttaatggtctaaaaatgagagcttatgtatttttgaatagttttaaaaatgatcattcctaacatttacaaaataatggaaaacataagttttacccagtaatcaatgctccacggaaggttaggtggccctgcagatgctaccacagcactctgctctgttgggacaccttttccaccatattggaatggactgtttccttgtctgactctccttctaggccggtgatccccaaagctttttggtcatatgccctaacaataaacatttgagtgtacctgcctatgtgcacatttgtttatttataaattatattcatgccctgtcattcacaaaaatgggaaaaaggatgagatgtgtgtgggtcatcttcctatgtgtctatctacttctcaatcataatttcttcctgccccacaatggaccatctcaccttccatggtctccaacaccgacatcccactttggagaccactctcctaggatatgtgctcatcatccctcatttattcatttcccactgtctccagtaacacctaccctatgctgggtactatgctaggtgctggggatagtgggtgaaccacatggacaaggatcatgttttccatagagcttacaatccagcgggtgaaacagtgtcagataatgtcagagagagaaaacagccacaagaaagtaaaacaagatgatgtgatgttaagtgatggagaatgtctacaggggtaagagggaagtcacgatggaccagaccagcagctcagcaaaggcctctgtgacctgcatgaggagggggtctagtgggagagggggtgcctgggcagacagaatgtcaagtgcaaagcttccgaggcaggaaagaaggccattgtggctggattataatacatcagtaagaagagaggctggagaagctggagaggttggcagctcaggctggagagtcctgaccccactgcttactggctgggtggccttgggtattaatgctatatgctgcccagggttattaaaggaattatgtaaaggattgaaagagtaaatctatgaaacatcaacatcagttagaagaatgcccagcacacagttggcatcaacaaatgactgcccctagggtctgtttacttatttatcattagtctcccctgtggcatggaagctgggcctggccagttttctaccctgccgaaccagagtagctggcaccatgcccagcctatagaaagaactcaatgaaaatttggtaaatgaatgggttttaaaaatgggtaatggctaaggaaaatcagaatttggctaaatattaaaaaatagattttcgtaaacaattttttctaattataaaagtaatgtcatgtcttcaatattttaaacaaaaatggggtcatattctacataccgcttagtacctattttccactccacatgtctgttacaagaggcaggagaatgtaagggtagggatgtgggctctggagacagattgcctggattcacatcctacctccaccactggccacctagagcatctctctgaagttaccaagccaaaggacatttgggatttttaaggctttttaacacatattgccaaatagtctttaagaaataggtgtgagcccatctcctcaaaccttcatctacgctgactgctaacctttagacaatctttgccaatttgttaggggaaagaacaacctttcattgttctaatttgcctttctttaattaccagggatgactaacagtttttcatttgccttgttcctcttgcgaattgcctgttcatgtttaaaaaggaagcccgttttcataattagatgcagcagagtaggtggcctcaaagtgaactccctaccgctgggaagggttgagcagggccaggtggttgcccatcagggaactgggcatctctgtgccttgtggacagcagaactggatgagctctgaagtcctttattacactgggatcatttcactcttgtccagaccagcaaaggtagcaggcaaacctcaaagaaaagatggcttgcggatcaacaactggattctgaagacctccaccaggatttcccaaggtggatttgatgcctaaacatctctcataagcttctgcataaagacaccccagttatatcggagagaagagtcaaatcgacatggttatgcctctagtagctacagcatgccacagtgggggaattccttaaatctcccccttgacaagatggaaaaccttcgtggtcatagatcaaatcctaccacaacaaacatgttcataatcaaggtcagcatagcacaaagactcctaaggtggggccagtggtctgtttatctcaagctataacttttttccctgctttgcatttggctttggtacaagaatttgacataaacaccctcctaaccccactcccctacaggtatttacatagcaattttctcctgagctggtcaaaaccctgctaggacttggagaattccattgtgtttgtagtaagcagacacctggagccagatagctcttagagaataaactattcttggattggaaagggatctgaatgtatctgacgccctccttttgcaaaaattttgcagtgttttcagaggaccttctacattttcactaaggggatatttccccctaatatctccaccattgccattgttggagtttcctgctgggtctggcccccacaggtataatgccagctggaaacagaacactcacatctcttaaattactccactaacgaagaagtcacacgtggaattagaattctggctaattttcctgtgggcacaccttaagcacacaaacctgaaagcagcagagcagcgaaactggcagccaaaataaagcaaaaagaagaacatcttccaggagggaggtggaatcagattgaggcaaagccaggactaggttcttggcaacgtgattaaaatcccgaactacgagggaggagaggccttgctgccagcccctcagcacactcgagccagggcactggaggtgggtggtggttaaaagctgtgtgccattcacagcctatagcactgcctgtgtccgtcagtatgggcagaatggctaatgactccaaataaaactcctacaccatgctccatctggggaccatgttatagctgaatacacaaagtcactttgtagcttgcccgataagtccactttaattcctccaaaataattcatggaggcctgtgagcacactgcaccaggccaagcactagggttataaaaaagaaatgaaaaaagaaaaacctagttgctctactctaagggcttatgatttaaccaaggagatgagattcacaatggtagctggcaatacggtaaatcaaggcacaaagaatccaggagtgtgttctgctagaggcccaagagggcagctggcattttcaggaggatgcaggtcagcctttatgggaaaatggattgagtttaccttgaagggtggggaaattttaggcaggtggctaagaagtgagctggcctctggggatgtggggagactgtgagcgccgcatgagacaggctctgcatcctgcacatgctgcctgcatttccagccctgggaggaggatttgtgcaagggaggcagagatgagagcgttgataggaaggaaggaggccagatttcagagaggtctgaatcccacacagagaagcttgggctttctccaataagctgcagggagcagttggagacttgtgaacagcagattaacataattaaataaaaacttcaagactttagctttttgtggggatgcagactagacgagaggtgatgagaacattagaaagcttttacagtgtagaccaggctggccacggtgttggcaacgggagagaaagaaatagatctggaagataccacaaagcaaatatctaaagggcttggaaacaaatttggccggggggcggatgaaggatgagtcaggggcagttctgaattttaaaacttgggggatgtgaggtggaggtggcatcgtcagacataaagacacaggttcgagcagctttacaagaacttaaaaaggccagaccacccaaaggtggcactgactggaagcacgaggctacggacaatgcttcctcatttcaaaggggagttaacaagttaagtgaagttttatccaccaatgaaatggctgtctgtccaaacaaataagcaacaagtgtgggctctgcactcctctccacctctcttgctccttccgttgatgctcccctaacatttatctgaccataagctaagagcagtcatgagaacaagatagaaatcctcagaaatccagaactctaatccttccttctgctgaaatactgtagggcttagttattttcacacttatgcatatgcttcagtgtgtaagaactgagtcattgttttcttttctcctcccctctcccctctctttccctcctctttgccacccagcacctcctctgcctccacccccaagccactgcaaacatcctggcatgcatctctccccatccatttctgcatggctgtcaacatttcccattccctccaagcttgcctcctgcctcctatttctttagacacactgggagtctaagaaatgaactacagattcaacaggactgtggaccacagatcttgacaaagacaggcagcttgttgtgaaaagagaattggagggcaggtcagagacttaggttttaggagtcaggcaagggaatcagataaagatccctgaaaacaagggatatcatcactgcccagctttactgacgtagagacaagttttctcacttggcagatatagacggaagataagcaggttccctttcagatggtaaccccaagtgcagtggctcacagctgcagttattctgaatggcagcgggagggaaggaaacaatgaatgcacacacacacaagagcaatgcttaaggtgaaatggacttgaacagtctcaaatgcacacctcctccagttcctggaaggcaaggatgagtcaaacagaagttgaatttcacaggcgttcctcctccactgtcacatacgttcccagacgcagagtcatctgtgcacatgtcacccagcatcgactgctaccagcaactgcctcctgggaagttaagctgcagggtcagatctgcttctgctggggagctgaaagtaaactgcgtaaggtgggggtgatcccagtaatgtgagggcaggaaaaagcagagaacgctggaaaaggatggcaggaattaacatggctctgaagagaggagccaaggatcacctgatctgtagagcctggaatctgcagttatttctagtttcctagacaaccctgactaaactaggaagacatctgaactccggctcaaaaataatataggttcttggaatgggacaaaagaagaaaggaaaggggaggtgataccatgtgccagttcagggagtggggaccagaccttcagagaaaggaaggtcttcccaaatggaagctgaaatcccagtgggcattatgctttctgtacttttgcatttgtagccaagagcatgattctaattctggttctccagcggaggtgcgggcagcacatgtgcatgagttcgtcaaaattgatctaacggcacacataagatctgtacatttcactgtatgtaaattagatcctagtaattctacctctctcaattagttggttgtgtgaccttggacaagtcatttaaatttttgtagtccaggattctccatctgtcaagctgaagctaagaagctggcctctaagtttctccctggctctaaaatttacgattgtgagagctgattattgcaggaaatgagcaaatacatccagattaagaagggccgcaactattgatagaagctaagaagaatttctgaatgggattagccatctgcagaaaattccccctaaatcatccatcctggaatcagacgtggagagaggtgaagattccatcctctgcaccaaaaggaagtggcagcccctcctggctctgcattttcccctccttcccatccgctctcccctacagactctctaaattcttccactggagattccccaagggctcaggattgggacaggccttttcttcccttccttccaaatttcctttgggtttatagcaccctggtcgggttcacaggaagggaaaggagagggaagaaaccattcacatttgggtgtgcgtagcaagcagagagctggagggttacagaaacttagaggaggtcagagccagacaatcatctccccatcctatgtcttatggataagaaaatgaagatgcagaaaactagtgtgacttctcaccatttctaaagccccggaaagaacagatcaaggaggcagctgtggccatcttcaggctggttctttcacatagagatgctcctacttactccataaatagtttgtcatgggcaactttcagacagaggagctggaactaccctaaccgggcactggaacatgtgtaagtagaccacctggctcacctgtttctcttctcagaggggctctgagtcatgaggagaacctctggatatgcagaatggataaactgcttctgtcaggatggaaaggaattcacagatgtcttgccagcagctaaccagtgacacagctgaatggtagcaggcccatggaaacactctggataagaaagactatcaaaggagcatcaggtccagattgcaaattgctttagcagctaacataggcataaagacagaacgacccactctaatccaagggggttacgcttcagcgctggctgcctctgactctcacccttgacccagcccattcatcagtatgttgataagcagattctcttcacagagctccttaatctggtttcccagggaggtcttgcagagattaatgagagcactgtgcttcctgccagtttttgaggctgggacagttaaacagcaagggtgaaggagcttgtcataaagtacacaaaccatcccatcattggacttgaccccattaggtggttaactcaaacatcttctcaatgtagacacttggatctattttttttattcactctctccttggtagccagcaaaattaaagcccttcctcatatcatcgttcacgccatcttttataatagtcacagccacaacagcagctggggctaaacaaagattaggagcaataaggatcagatgggacagacaggagatctggtcctaccaaggggcatcaccaatgagctggacccactgtgcagcccacctgtcaaatgccatttgccacctctggcggtgatagcaggggcagctggggctgaatccatgaatcctgaggtctcacagaagtacagccacccctgtcatctagcccctcccctcagaatatgctctggggagctgtcacatcccacactgcaggctgatggaagacacagacacactcttgggtcctggcattatcgctgtttcctctggttacctttaaagaagggcgtctctgagtgctgggtcctccactggaaataatgtggggaaactggatgagctctgcagagatgagaattattttgaagcaaagtaagaaatgaccagggaactctagattggaatacagcttgtgaattcctaggtaggtgtagactcaagagtttataggaacttatatttgctgttattttttaaaagtcttaaaagttaaaatttacagcaatagcaagaaggaggacaaagtgcaacagctttaactatgagctaataccaaggttaacactatctgtccattacacgtagctttgggatttggcaaaaaggaaaaaaaaccacataacacggagctttgagctcataaataggtcccaaagacttgacaaataaactaacaaggcttttatggtagaagggagcatcgaaatctgaggccttctgtgccttctctccccgctgctgtgatggcagctggcaactgggccctactgtccattaacaaaacagagagacggataactatccagccgaggccagcttcctcacaccaggcagatccacagtggactctcaggaatcttcagcaccctttacaccagcagtggtcaaagtggggggtgcagctgccttgggactgagagatggggatggacacatctgcagggaggggtcaggctctagcccctttccccaggccaccactcctcagaggctggtcctccaccccagcttcagggacaggggatgcatggtggaaaccactgcagctgctgcattagcaaccttcaagagccaaagattctcttctctctagccagagagggaaggcaaacaggttagggtgacctgcagctcagggtcggccccaggccaggccactgcctgtactgactcctgggcctctatgcagtgcactccactttctagggcaggctgcttgccaaggattcacagtggacctggctgctccctgtgggactcactggatctggacccaggaccaagcctgcttgccaggagcagaaggtcaggttggtttaaaaaggtaacctctgtcctttcccagttccgttcctttctcttccccagctacctcctcctcttctccaaatcagccttctcttggctcagtttctgaccttgggtattttccccaaggaacacatccgaccatcaggcactcaaaggagcatgagcctagtcttttcctcaagcaaatcaccccggtacagtcagcagctgcagagcacagggagctcctggcatgctaaaggtcatttacagatcactgaaaaatctggacaagatgctaatgtcccagctcaatgcccatgtcctgacttaaaccttgactgtgtcttaaggacactcaacgtcaggatacctatgacagaaagagggacttctgagtatttcaggcataacaggcaaaacagacatctttaaagcttgcaaaatatatgattctgtcattcctctgcatcctcaccaccaccatgatggagagccagggccagtctttccaatcatcactcaagcttccagtggctattgggcactctccctcttagagaggggacactccagcaggaactccaggtagagagctgttctgcagtgggcatttctagctcagggccagcctccgagactctccaggagtggcatgaaatgaggtggatggggcttccttgtcctggccatcatgtgcctacagcaggcattggcaagctttttctataaagggccagaaagggttatggaccatcttctttgatgtttttattttacaactctttagaaatgtaagaatcatccttagtttgaggtgccatataaaaacaggcggcaggcaaatttggctcacaagcaggctgcagtttgcagaccccctcctagaggaagatgctgaggcctcaccaagcagcccctccccaccttccctctctagcctgactcctccagactcattccagctgcacgtggcacctgtactaggccgcaggatggccttcttgctgcaggcatttcaatgagaaaatatgctgcatggatcatgagtgattctgtctccctcgtgcttaaccttggaagcacaaggccctgctggcctcacctcaaggtctcacctgcccatactcatgcgaccttgtccaccatctctccactacgaggtgccatctggtaaatggcctaacttgggttcttcctcccacgcctcctgtgtaggttcagggcagggagaccaaggtaaatcctgtcagttctatctgaaggcagagcctggatccaatcacttcccacccctccaatgctatcacctagaacacagccacagcctcccatctggactccctgcttcgatctctgccctcccccctccccttccaaaagctcccagaggctttccatctcactcaaaataaaagccaatgtctctgagcagtgaaagccacccaccatggtcatccaggtcctatcactgacctgctgagccccaactggcccgcatggccacctggctggcctcagtgcctcctctttcccctagctgatactaactccagccacactggcctccttcctaccctgcttttcctcttagccatgaacaccatcagtagttatataatagtttgtgggggtttttttttttttggtcttgtttttctcactcaaatataagctctgtcaaatagagtctgacttcagtgttacactccagggcccagtgtcagccttgggtaggtgctctacaaatatacaaatatttggagaatgcatggggacaggatgccctgctgatgggtgagagatggtggcactgtcatgacactgtgtatcaatttgcacttggatacttttatgcaaataagtctcttgctcttaagtcccctcctcccccgccttagtagccagatgaaccgataagacactgaaaacagatacacccctggagacactagtctccaattttttgtttatattcaaccctaaagcaataacaacaaactcatattccaactgaactagtcaattatctcaggggaaaacaacaaacgattgctttatggtttagagcacacctgtgcgtggctctcccgcactcaccacaaccaccctcccatgagcacagcaaggaaagagaaagcatgggcttgctcagcagaggtctgggtttcaaatcctgacactgccatctataggtggtctgattctggacatggtaccaagtacactaggccttagctttaccatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctgtgtgtcacaagcaagggatcaaaaaagctaagagaattcacctgccctggatatcaactgcccttaagagatgcaaactaaaggtgactgccttcctttccccaagagacaaacggaaaccccactcagtgtgagaagagcacatgccatggaggccccagaccagtcagtgcccagtgaggagatgacagagcctgacgcagctacatctgagatcagatgccaaggacacagcaaagactgatgaagccatacgtgagacaccaaagtacgaaactcacattcaactcaaaggtttccatgtttgatgactgttatctccctgcacagtgtttttctttaaggagcacatgtgttctataatcctataaagtaaatttttgaaaaaaacaaaatgagaaacaaagggacacacagaaactcttgcaggtgacggatatgtgtattaccttgcctgtggtgacagcatcatgggtgtaagcatatgtcccaactcattagactgtacacattaaatctgtacagttttttaatatcaattataacctcaataaagttgaaaaaataaagaaaatttttgtagaacaaaagccttctcccattagctttcatcatgacattgaaatgtgttcctcttgaaacatattggcccctgacattataaaaatataaattattaaggaacaaatcttacaagtaacacgtttggaggacaaacaataaagagatggcctaaacaatgtctaaacagatttgaaacggagcagaatgtgagtgcgtctgactaaaagaggaggcttttctcaagtgtcagtcctgagacaaggaccctgggactgctgacatcccaaacatagtgcccctatgactccaagaagggaaggtgctgcaggggtgacggtccctccccaccccaccatcctcatctggctgatccctgctcatgcctcagaccttagctgaaatatcacttccccaaaaaaagccccccagcactagattgggtgactcattcactcattcactgagtcatccattcaacaagtgattactgaccccctagtatgagtcacattcgacttatcactctctcttttcaacgttgcaattaaataatcacacacacaatactgatttactgtctgtcaccctccctaaactgtcagttccaaaaggacagagattgtatctgatttgtcatttcattcccagcgcctgacacagtacgtgcaacatggtaggcatcctgtccatactggccgggtgaacgtacaaatgaatgaattaaagcatttgaaagctccattcatattctaaaattccaaaatgcaccctgctgtctactttacacagggataattgatgttacaatcaatatgacttttaaatttaacaaacgaaattgttttatttattaatctactagtaagtgaaaacaataagatgtaagacaacaggaagaaagttactctccctgagaggacagaacctgcaggtgttatcctgggactggcagaagcagcatagggtcatcgctgaggggagtgtggatagagtcaggctatctgggttagggtcttgacccctccactgaccagctatgtgactctgggcaagcaacttaacctctctgtcttccagttttcaaatctgtaaattgagaataagaatatcagcttcagataatttcattaacaagtaaatggattacgacacgtgaactgcttagaacagtgcctggcacgtgctaagtactcactaaatgtcagttgtttttattttctggaagaatgggaacaagatgggttaaaaccaaggacttggacatactgtcactaaattcacaaaccactcagaccaaatctccaagatttcctattacaaaatgaagtaattcaaaggcaggtggctggatgggttatctactccaacttccagacttactgctttacctatagaggtgatgatgccttatccatctgaaattaagggccaggtcaaacaaaccctcaaggtttctccaggactggagtctgggatttgattttatacaccccacagtgcccagcacaatgacgaacatgcatttaaagcttagaaaatgttcactgtgttaatttacaatgaataccatttaaagctaaaaaaaaaaaaacccctgcatattctaaagtatattatctagcatatgtgctagccccagaagaataaaatgcagaagtgaacaggagttgcttcatggaactgaaattaattatacacaattatctctgagatctttaaacagtaagtgaacaatgaaaatgtagattcagaattctcctggtaatgaataagatgatgaacatgtttccacagagggtgggatcaggttgatctgctgaaataaccagatagcaggataatttcactatctacgtgaaacattatccaagaatctgtgcgttactcgacaattaaatcagttcaaatgtcttatcaatgatttcatagaacaaccttcaatgagttaacaggaacccgtagataaaagacaagaatagggctacgtcaagaagctcaaaatcctcagctgctgataatgcaaaaccttggccacattgatgagcccaagaccaccagatctctttatactgagtcattttttaaagaaaacttttattttatatgttagttttccttataaaaataagttgtattgaggtataatttatatacagtaaaatgcaaccatttcaagtgaacagtgggttttgacaaatgtatatacccaagtaaccactaccctaatcaagatataaaaacttccataatgccagaaagttccctcatccttgataaaagaaaaacttcagccgaattaaatttaaaggagtttaattgagaaatgaatgactcgcaaatcaggcagcccccagaatcacagcaggttcacaaagactccaatgcagccatgtggtggaagaagatttacagacaaaagaaagggaaatgacatagtacagaaaacggaagtgaggtacagagtggcgggattggttacaagttggcatttgccttatttgaacacagtttgaacacttagcagtttataaatggttgaagtatggccacagggattggccaagacccagctattgttacaggcacatactcctaaatcttgtctacctattaagctaggttgcaattcatccacaagaactcaaatatagaagtacggagtccttctcaggccatatgcagtttgctttaacacactctttctcggttaatccctgctcttatctccctctatcccaccccaaggcaaccatagttttgacattccccctatagattagttttgcctattctaggatttcatgtaaatggaattgtacaatatatatatacttgttgatatctggcttctttcagtctaatgctttgaaaatccatgcatgtttttgcatgtgtcggtagtttgttcctttttattactgaataatatctatttgggtggactgcaagttgcttatccattccccagttgatgggtatttgggctgcttttagtcttggactgttttgaataaagctcttatgaacatccacgtacaagtcttccaccaacatatgtgttcacttctcttgagtaaatacctaggagtaaaatcactgggtcatatgctgtgcatgtttaactttctaggaaaatgccagatttatcctgaataacagaaatgatcaactgatttactattaaaggacttactggattttataaggaaaagaggaaacgagacgaaagaaaatgtagtgcatctgaaagcacatgggggctgctttgctgaaggggctggcaggcggcttcccaggcagggtctgctcaggactgctctagccagatgcctcccctggtgtttacttcacccacaggaaaatggccaccttcaccccaccttcagtggacgtgcagccccttcggtgctcctctcttcatctgccttcagaggtagtcctgattaacctgttgccagcagaattttctaggagagacaggacttgggggtaccactaggccccggggacatgcactcagctggcccaggcaccgataacctagcatgtccttttagaatttgggggatcccggcacccactgttctcagctttgggcctcagctaaggccaggacaagcatcatttaatgtcatgtcatataattagtatggaaactacaaaaacctatatgtttacaaaacaaccactgatctacattatttcagaggtaatgatacttttacatgagataacttcccaagacactaagctgaaattagataaatttaggttttctgtattctcgctgacttgtgtttttcacactggctttatcttggtttctgagggagaatcaattctctttaactctcttccagaatacctcactaccttcagaaaggaagaaggagggaaaaaaggacagagggaaggaggaggattagaattcctcatatcagagaatcccagagctttgaagctttaaagtgaattcaagagtgggattcaagagaccaaaccatggggtctaggggaaataaggaacccctctcccagaaggtggagaagcttctcaaagcaactggcccaggcagccttgtacttgcttcattctggggtcaggaagaagctgcaggccctccttcccaccctcgcttcccttctcctccacactgtcaactctgctccaggaaggggcagtatccccagtgtctgctgggccagcacagccatctctcacccacctgagttcataatgactcctgtgtagagcagacttcccttggcttcactgaaaccattccttcttgtcttagaaagcaatcagaaatatagttaactgccttaaagttcccttatcattgaaatgaactagatcacagaagtgcctatttgcattttttattcttattcactgggtttttaaaaggagccaagagaggggagaggaaatgcatttacttgctgggatttcacttgggatgttcatgttcgtctggaaagcaaaataaaggcatgaagattgcccactgatttcctttcatttggagaattctgcttgagttaggcttagctggctagcacataaacctgtcaagagaaaagtcttcctcttcctgggcctggtatgtctaccacctggggcttcagagacagtattctaggagattcacagtgtctaaggttcgaaatgtggacttcagcagcagggcagctgccaaacgctttcctgcccttgcagaaagccaccaccaaactcaccaccacctccctcaccgtggcctctctgtttcagtatctgagcagcgggtgaggaggactggattctagaagataaagagagactccacggtacagaaagtaagccctcaataggattctattagaaaacagctggaaggaactgtggagtcactcagtcccatggctgattttacagacaataagcaaacaaacaaacagaggccctgagggatttagttagcggtctccaagtgccagtccctgaggaaaggattctcctccccagctacctttcccttctccagtgtgtccacctcaggaaaagggcttgcatcctcccagctgctcacacacaacttgggctggccttggtgctggctctgtcctttctcccaccagatctgccttccgccctcgccacttgtctctgcccagggctcacttggaaggaccacatcaatgaacaaccttggcaggtcacagggagggatggagcgggggagagaacagcaaataggcttctgccctgcaagagagggagagccagaataccagcctggcttgggctgctcccgaaggtcctggctgctgcctgcaatgcagcgccttccttcagggctccagcaccatcccctgtcctcagcctttaaggctctactgctctcagccccagccctgcccttgaggctcccctgtaccctgtctttgtagatggtgcctgggaactgtcccgcttggagagtgctgtttgctaggatacacactgactcccatggctcccctccagctccccatccatcctgctcctggccacggcctctggcctgaagggctgcaaaacagccttccaactgggttcctggcttcccttctggcccctcttcatctgctgtccccagcagcatacagagctatcccatgaaatataagtcagaccatgtcatgccctggcttaaaacctctcaatggtttcctctggcatctccagtaaaaatcagaactccttgctgacttttgagagctgctctagacagggctgctctctgcagcctcctcttgtgccccgagcttcaggacactccagcagctgtggggcctcctttcccttactcatgaccccaggctctgccctgtctctgggcctcacacatgctgtccctgtgcctggcaggtgccccgtcactggtacaggctgtccccacccctctaggagagccttgccttagcagggtacatgccctgcaccttcttctctccacgaatttttattctctatccctggactgtgctcatttctttccaaacacctaacaaatttgtaattatgtgattttttgtttactttttaaatgactctctcccccaccgggatgcaagttccacatgggtacgaactaggtctgtcttgttctccacctgacatacaacagctactctagtcacatctacaaaacagcaactgggtttgggttcctataaagtggacaactctcctttctggggaaggattgcttcataatctgagattatgttccttctactttgttggggagagtgttaagttttttttttttttcttttatgaaaggatagtaagaataaggggtattcatcaaaaatttttaaatgataacctgatataattctccaaaatgtttttaaaatttttgagtctatgatatcccagattaagcaatgttttgggagtcacagtgttgggtcctagagaggcaaagagataggtgaagatagtgacagagaagagaccggctttgcagtcagactgcagggcctgggttcaagtcccaactctgctgcttggtagctgtcaaactctgagcgagttgcttaaactctctgtgccttagtttcctcatctgtaaaataaagataataatagaacctgtttcagaggactttataagaattaagtgaattaatacttgtaaagttaataaaacagtgcctggcctatagacaatgcttgacaaacattactgctatcattattatctattattattattattgctattgttattattactaaacccaggtctcctaaatccccaaccaggactcttttccctttaaaatgttatctcccagcattgtctctttaaatgttatctggccactcttaaatgtaagactgaaattcagcacttggaaaactatcccactccagccaagcacattttttgaatagctaaacactaaccctgataaaatgtatccatttaggatagaaatgtttctacaatatgttacatcttgtctactttctaactgggttttttgagatgagtatcattacagaaattatctgctgtgcagcctggaaacagcaaaaggaaaactcagcacgttctacagacgtgggttcaaagccctgctctgtcctccctccaagccctaaacccctcctgagtttcagtttccttactgaagaagtgggaaggccatgtgcattgagaggttactgtggttttgagtccagtgaatacacacactgctaaatcctaaaactcttctttcttttttggttaataatattaaactcatccaggagaataccttaatttaagactccaggcagaattctcctttccccaagctctgccaacacccaaacccctccccagaagacagcctggttcacacaacagaggaacagacccctcacgactctgcagggggaattcctttctgggagagaacacatgtccaatagggccagtccccactcaggctgctgctgtcactcagccagaaggcaggacaggcttttgaagctgtgatatttctgagtttggttttggacaaaaacaccattcttcctcatagcctttcacaccctgattcaagcaattttaactgaattctatttcccttcaatagaaggctatttgaagatacaaaaaccatatttgtgaatgaattctaggattgtatttgcagagtcactcctgttggatttcgtgctctataccaagtgtatttctacctctgggcctcagaaccatttctcacaccccccaacaatatctcatgccctcatatcccaaatatgcaattacctatcagttgtgaaaggtaaaaataaaattcatatgggtttcataggtcaatggttcatgttaaaggagacccatattaaataatattattaagtagatatttataaggctaagaataaaaggtggggaaatgggtgggattcatcttatctttctaatgttcattacctagaacctggaaaccaaatcaatgaattttctgactacagactcaacaaatatcatttgtttttaatgataatcagataatttaaatcagataatctaaatcaggtaatttagaaatatctgatttctaaactagtcctggactacacttacaaagaaacagcactgctatagagaaaggatgaagacataaattggagacaggaaacaggaccagattcagaacactattcctgcatatgagatttaaagaaatatacatacataattttacaactcctacaaagcctaattttatttgtaaaatataccagggtatcttagcaagtttctttggaaccacgcaactaagagtgctttttaattaattgcacatctagcaatccacaaatacgaattaagcaccatgagttggcactgaggagaatttaggtctgttctcccacagagcaagcaatttgcgaaactttgctctaaaacacataaaaaccctggccttagctaccaattttaaggatgttctattctgcaagggttcatcttcattctctccaaaaggatatgagggtcctgctgtatttcaatggaaccagacccccaaggctcagaaatcaatcatttcacaagaaaaaaagggtaagattatatctaaacatttcattagcataaatctgaatgtgtgatatttggtcattttgtcttagtttacaaccacctttgcaagtgataaaatatagattgatggtggggagagggtaggagaagaaaacaccacactcacatcacgggatctaaattccaccagcaggggtgggagctgaactggcctaacctgaatgtatgtacaaaagaattccttccttcctctctccctcccttccctcctccctcctcctccctctctttctaactccctcccttccttcctctccttcccccctccctccctctcttcctccctcctcctccctctcttcctaactccctacctttcttcctccccttccctctcttcttccctcccttccttcctccccatctcctgccctctcttcttccctccctccctccctcccctccttccttttttttcctacctttcctttccatcaacaagcccaggtgatggcagggataccgcatactccacttgtctcttccacggctggggatggctctatcagcacttgccccatttttaggttttacttcccaggtcatcccagatttataatccatgcataatgcaggcacctaagcacttctgggcccctactagaaatccagaggcgaacaaggcccagtgcctgcctgttctcaagtctccatgcaatgggcaccctagcggaaagaacacactctgagattaatctggcattgcaggggacttgcaggacctgttccaggtgcctgacattatctatctagaagaggtctccctttcagcacagttattgcctacatgaaggtggcctctctcaactgcacaggatgtgccattcgccaaggaatactaggcatccctccatcgtccagacagatctcaagtgagatgctcaatccctataagggttggtttcccctcagtggattacaacactcagatcccaactttccactgcacaggataccttgcagccatttggttttgaatgaccttctcttcccctcttcctgaaaatataagtttccttattgaagccaattaaagccaattctgctttaacatattctggagcacttcacagcatgctttaaattaagcaggaacaccctggtctagtggtactgcctccaaggcagtcctcccttcatctccctgcctccagccaataccctgcttctctgtctcctcagtccacctctgcctgctctgtccctggtttcctccacctagaaaagtgcatccaactgattttaagtacctctgacttaggggtaccacactgtgaaacctctgcttctatttcctcttctataccttgcattgcaagaaaatctaggctttttattcattttttagaaaaattagggaagtcacagcctaggtagttactagaagaaacaggcaaggccaagaaaaatagccaactcacatagagctcttcttaggtgcctagcatggtcttaagtgctttatagatactgaccattaaacctcaccacagtcctatgatgtagatattattagtgtgcccattttacagatcatgagcatgaagcccaaagaggctaattagcttgcctgggatcatcctctcttttttcttttttctgagatgggtctcactctgttgctcaagctggagtgtagtggcgtgatcatagcccactgtagccttcacctctcagtctcaagcgatcctcctacctcagcctcttgagtagctgggaccataggcatgccaccatgcccaagtagagatgggggtctccctatgttgcccaggctggtcccgaactcctaggctcaagcaatgcccccacctcagcctcccgaagtgctgggagattacaggagtgagccaccatgcctggcccatcctcttaataaatggtagggctgagatttgaacctaggggcctgactcaggagtgagtactgcttaccaggaagggaatgtggtcagcatgacaacaaaggcatctctgtcctccttaaatgcagcaccaactctgtaaacacacagcaggagctctagatacaccacgtttgtacacatttactgagtctacatttccatgtcaccttcaggaagagtggattggcttgggtgaggagaaggaagaagagcggagacttccgcccttgagagattctattttaatttttaagaaaacactgaacagaccaagccctggatttcaagatcagttttcgaggtctccagacatgaggcagtcatctgaaaaggaagacatgacagaggagtctgacctctgtgtggcctccttgctctccctgcactgccttcagatctcccagtgaataggaaaggaggggagacctgcatctgtggggcgagcatcccctaatcctgataggcttcaaaaggttgcgaaaggggccacattctctagtactaagacaatggcattaaatctaaatttcttgataaccaaactaaggcataaaggccagttaactatgtctagttctaatataacactctggaacatgccctgtgttatcttagcctagcttcctagaaatactgaatcgcaatattccacaatgcaagttcctcccactaaaggcctctttggagaaaggagttggctgtgacaaaggctgtagtatatagaggatgatcgttatggtggtgatgacaacagtgctgatagattagacaatagcaacaatgaccatgagggcaacgaagaccatgagttgtgcaacatctaatacaggtcaggggtgaatacttttgtgctgactgcttttcaagcattattatgttatatcttcacaacaatgatgagaggtgggtatcagcacaatgccccctttgaagatgaggaggagttagatgagaaaggccaagtctctggggcaagttgccataatttgggtcataacatgaacccaggccaatctgactccaaaatttcacattcttatccactgctcatctctctcttcctattagaaaaccttattatagaaagttctaaaaacgatatgctgattagtcaaattttctggtaaatacatagtaatcagttccaaatactcaattgaaaaaaattgccaaaatgttcatggtccccagtcctgccttagtaaatatagcacactaaatataaatctagttctactttattaatagacacatgatggactatctcccagctatttgccagaacaatctgttcttattgtagagtatttcagatgtaggtacagcattgagaaggaccatacactcagcccagggcatgctctgaaactacggtattaaacattaaaatctttttaaaaatgtgttttattatttgcctttttcttacaaaacttcagtccaaattatttgggttgataagtagaagtttcactgtagtaaactgtaccaatggctgcctgtggtatgtccagagtgtaagagagttgatgagaaacaacaaaagaaacaaacaaaaacttgaaaatataacaaaacttggcataaaaattaaaatgaccagccccctgatcctaaggaaagtccattttctcataggggcagtcagtatatttttatcttgtggcttaatgtttttgtagacacattaaatcataaaaatccaagaaaccatatctcactcccaaaccacacaatgtattttaaggaatatgtcccttttctaagaaactgcttgattttcaggaagtggtaaagtggcaggtgtgttcccatgatcagccagagaaaccaaataaacgttccactgggcaaacctgtttctcacagataaacagctgcgagctgcacgcgggagggaaaaggatcgtaaagactgcccctatgtctgcctgacactttctggttttctgtttcaattgaaaaggaagatggcagcctacaactgagcagaccctactgtggccaggccaatcccagcccctgcatgggacaggagtttcaaaatcccagcactagacagaaggctgtggtcatctctcctctaggtagacctgggaagggataattaaactaggagttgcaggagaagcagatttcccatgaaaaagacatcatcacacaattaatagctaggcttgataggaaggggaaggaatgtccctttttacttacttccaaggcagcctccaccttgcttctcataccacccatcacattggaaacaatcaccagtctgtatcctcagcagactgtgagctcctggaagtcccctgggcacataacaagcactcaatcaatgagaattattgttattacagtgtgtgttcaagaaatatctgttgagtgagtggaacagaggaaggaatgaaataacttgactttccatttggaaagtgtcttgctaaatccttgctgttagagttcaggagttgggataggatttcctatactgccactttggtttgtcatgttgtaagcagggttaaaggcaaatttttaaaaatatgagacagggctgaactggctttctgtctagaaattctagattaaaataagggtctgtctaggagcggggagccagctggctatttaggaggcttggaggttaaagcgaagtctaaatggagtaagagacactattccaaggggtcccctggtcacacagaaaatacaggggcagcattcagactacccaggagtctgcaggacttggtatgaaagagcaaaaagaaaaaaatatatagacaacctaggaggtctgaggactcacagacactgactggctggggtgggactggcaggagctgctgggaaggctggggcagcttctcagtggtcctggcagtaaatactatccaggaaaagtgtgccttgcagtgagagagctgctgggaaaacggcctggacaatcagactgcagtgctgtgagctagattgcccttcccctagccaagaggtgtctcccaccacccttcccctaagcagcataagagtgaaacggggtggacagctaatgcccactgacctcctgctatggaccacaggcactctcctgcgaaatgcttgtgaggttggtgacatcaacattacactaatgacaaaactgagcctgagaactgcaactcacctgcaatggtacacctgacagcagaaccagaactttcactgaaggcttacctctccagggccaaaagagaacctgtgaccccacaggatcgagcctgccccctcaatgcctgtcagaggcagcctggtgggtgcagaatgtgatagcaagttgctgttggcacggcctgctcttctgacagctctgcaggttatttctcacaactttgctgccagcttctccctgcctgtcgctgacccctgtcccagagccacctccatctggaaacacccaccccccaactctaaagttgtaaccatacatacttaagctagaaaatttaaaaggacaaagcagaaaggaattaagaaaaaaatggagtaacctattattttacagagaaataattttaacattttggattaattccttcacatacttttcttttgagatggagtctcactctgtcacccaggctagagcagtgcagtggcgaaatcttggctcactgcaacctctgtctcctgggttcaggtgattctcgtgcctcagcctccctggtagctgggattacaggagcacaccaccatgcctggctaacttttgtatttttagtagagatggggtttcatcacgttggccaggctggtctcgaacacctggtctcaagtgatccacccaccttgacctcccaaagtcttgagattacaggtgtgagccaccacgtcatgagccccctccagtaattttctatgcatttagatgcagatactgtttgcctgtctttaaaatggtgttgcaccagactaactgtttagaggtccacttccctgctcagctgagcactgacacatgcaacctgccacctgggaggatgggcaggcattcccgaaatgccatcatggctgctgctaaccatcccgggattgcaggcaagtgcggctgatgcagaaggacgttggggaatgcggacatcaggggtttgcaaacttgtgtttctccctccactgcccatcctgccagcctcagaaggttagccatggagggtgggccaatcccaacatactcaaaaatttaaaatcctgaagggttagcattggaagggattttagaggctatccagcccaatcccctcacttgcaaatgaggaaagcagagctgagagagatttagcttgtgctgggttctaacagtggctccttgccaacctcaggctcctcctggtctaccgtctgtgcctggactctgctccagcacccccacccacccacccacctgccccacttggcagagggcagcagccagagaaggcaggcccaggtgggggacaagagtctcaggactcacctttcaaatttaaagaatctctcgttaccatcaccataactcttagcccaaccattcctcttcagatccaaggatatctaagtctgactgtggaattttgttgcggaggattggatacagctgtcaaattccaaaggcatccagtacccatgctctccacagagcagtcccttattatacaagctctgcaccagctgagaaccatgttccagtctcatattgctcagaatctcctctgagcttcacataactcaggcacaatctccctgaatcatatggcataggaaagtcatgagcagtaagacttggttcaagaaaaaataccaagttctgaccactcaaagtacccttaggtgctctcattcatgtgagctttccgtttcctgctctccagccccatttcttatttgggttagggatcccctagggctgctcagtggtagggggccactgaattcaaagcaggccactgtactcgaagtagatggctaggaaaaaaaaaagggccagtcacagtggttcatgcctataatcccagcactttgggaggctgaggcaggcagatcacttgaggtcaggagtttgagaccagcctggccaacatggggaaaccctgtctgtactaaaaatataaaaattaactgggcatggtggtgcatgcctgtagttccagctacgcggaggctgaggcatgagaatcacttgaacccaagaggcagggggtgcagtgagctgagatcacctctgcactccagcctgagtgacagagtgagactccgtcaaaaaataaaataaaatccttccttccttcctccttcccttcctccttcccttcctccttcccttccccctcctcttcccctttcccttcccccttcccttccattcccttcctttcctttcattccctccctccctcccttcttccctccttccttcctatttctgagcacttctttcccaggcacaaggtaaacgagctttcaaatatagcacactgaatacccatgataattctataaaatggatcctattcttcccattttaaagatgaagaccccaaggctcagagcagtgaggtgcagatttactgtgatgctaaggaagaaagtttcagggccctgccagcatggacccctttcaaggccctagcaatatattcttagaatcatgtaatttttaaatgaaatttgcagtagtaagatattttaactgcaattgatgaagagcactgtatctttcaactctgatgtctcctcctgatacatttcccctcatgttcatattgaatggtgttacagtagctataggtgttttgggatccagcataagggaaagttaatttggggataaatttagtttgggtgtagtgggatttatgtctattgttcacagtcacgttaatgcaaagtcaagtgattgttagctgtccccatggcttccagtgctaagctttccacaactcaatggctttgagactcaaaggtgcaatacctggcacctgagacataaaaataggggagaaaaaataggattgaaatatacagagcggtccgggtgcggtggctcacacctgtcatcccagcattttgtgacaccgaggcaggcggatcctctgaggtcgggagttcaagaccagcctgaccaacatggagaaaccctgtctctactaaaaatacaacattagttgggtgtggtggcacatgcctgtaatcctagctactcgagaggctgaagcaggagaattgcttgaacctgggaggcggaggttgtggtgagctgagatcgcgccattgcactccagcctgggcaacaagagtgaaactccatttcaaaaaaaaaaaaaaaaaaaaaaaaaagaaggaaaagaaaagaaaaaagaactatacagagccagaagctagagcatagaactttcttccagtctttggacatgtggaattgaaggaaaatttagttttcactgatgcctattcgaaaaagaaagttttctcctatcagaaatgtatttgataatataatgaatacagttataaatataccagacattttccccctttttggtgggaattacacaaaatatattttatcaaaattcctgtattgtaggacccaaacctatggcagtaaaacaaaaaaaagtggatgtctgtgtctgaagccatgttttatgcaatgtaactatcaataataaaaaataaatattgtcagtcatgctagaagaaaagctaaattttctttgcaacctccctttagaaaaattacaaaatcactatcatatgaagaggtgatcaaagtgtattcagccaaaatatattcagggaaaaaagtattatggaggtttcacaggcaaataataaaaatattttgttatttttctggattttataaagtttgtgatacatgtcaggttttaaaaacgtatattgaatgtgatttattttcttattctaaataaatattcaccatggtacctaattttgtatttgtaattttatattctttttcttaaagaggtcccccagttgcttaaacttcaagccctacaaaatctcaacccatccctggaggtgaaataactttcccagccaggaagtggcagacccaggactagagaacttggtccctgactttgggatcccctgaacttcacacatttgtgcccagtcatccatagggcagcctgggctacaagggtcagggtgctagtggagaaggtcaaaggatgatgaatttgtaaactggataccatcactgcagccagcacatgtggcttctacctcacctgagcagacagcaagaggttttctgaagacctgagtatgcaactgacaaatcccgactctgttaaaaccaagtgcccagattaaagataaatagccccaaatccccaaacaatataattgaatctggtttgattcttctgggtgtcacattccctaaacttgcactgtccaaaatggtggtcctggccacatgcggctatttaaattaataaaaatgaaatgaaataaaaaatccagtccttcagttgcagtaaccacgttttaaatacttaatagccacatgtggccagtggtttctgagtcagacagtggagatatagaatgctcccatcacacccccaccccaggctctactgttaagcccagctgaacttttttttttttttttttttgagactgagtctctgtcgcccaggctggagtgcagtggcgtgatctcagctcactgcaagctccgcctcctgggttcacgccattctcctgcctcagcctctcaagtagctgggactacaggcacccaccaccacgcccggctaatttttttttttttttttttttttgtatttttagtagagatggggtttcaacatgttagccaggatggtctcaatctcctgacttcgtaatctgcccaccttggcctcccaaagtgctcggattacaggcatgagccaccacgcccggcctagcccagctgattttaaacagtctttactaagacatatctaagcccttcttctcaagaagagtgtttgcaggtgagtgtggccgatatgtgaggagagaggagaaggaggagaaaggaaggcctatccagagagaagagagggacagcccagctgagaaggggccaaagagggggaaaaaggaaatagaacctaaagtgactgaggtgttaggccttgtagagaataagggcatcatcagatgtgagccaaggaaatgattcagatcacacctgacagaataaggaggataaattagctccagaatcagttatcacatacctcatgtaccccccaacatacacaccatatacctcacaccccccacacacataccacacacacacatgccccccacaccacatacctcacacatgcgcacccccacatacctcatacacataccaaacacacacacaccacatacctcacacatataccacacacacatgcccccataccacatacctcacacacacaccacatacctcacacacataccccacacacgtacaccatatacctcacacaccacatgccacatacacacacaaagaccacacatgccacacacacacacaaagaccacacatgccacacacacaccacataccacatacacacaccacatacctcacacgctacacacacacacacacaccacacaacacatacaccacacacaccacacatacgccacatacctcacacaccaaacacacacaagcaccacacacacaccccccacatacctcacacatcacacacacctccatatacctcacaaacacacatatctcacacacacacacaccacatacaccacacaccccacacctcacacagtcccaccccacatcccctgctacacacaaactcacacactttaaagtgtgctttgcattccaagtctttgctgggaaaccttagttgcagctttacgtggctggaatatcaaaaggcaggagttgtggagtcactgacaataacatcatccaccttctcaatgtccccgacactgccacctcattacccaaaagccactgccattccagacctacgcagagtctgaagggcagcacccccttctccttgggactggagggacaccttgcctcaactctcctgcagggcctgaggttaaactctcctgtattccaccatcaaaggacagcatgggggactctagcccttttaatgggctgccaagagcaaaaattcacgcattctagagtatgaaagcccggcagggtgggccttcatttcccatatgttagtgtgtatcgatggagagggtagggagccctgtggggaatgagggcacccattgtcccctgcagagcagttgtggatggagctcctgtaggaataacggactctgattaccacggtgacactcccaaggtgatggctctggatagggtttgcagtctcctttatactcatcactcccatctaatcctcacaagaaccctgctccccacttaatgaacaaagaagcaggcctagaaaggcaagtggcttgcccggaattaacaataatagtttaaccataataacattgccccatctgctcaccatccaatgaacaactcaagtgacagcacagtggttaagagaacagattctgaaacagatgtacctggttcaaatcctggctcggccaatgactagctttgtgccactgggcatgtgattcaattaccctgtgcctcagtttccttgtctgtaaaatggggatgatgatagtccctacctcatgggttgctgtgtggtttaaataaattttcacatgtaaattacttagaaccaagcctggaatgctcagtcagcactccttaagtgctggctgctttggtgcaggctctgagcacagagacaaccaaacatagcacctgcctccaaggtacttacagcctaaagggagaaacagaaaagtgaacaagagctagggtagaaaagatgctcggggcacaaatgagggacctggaatccaggaagggcctgattcctgggccaagtgacaactgggttgagttctgaagagccacagtacaggcactgtgacagcccttatttatgttttccagcttttattgtagattcatgtgcaggtttgttacctgggattattgtgtgatgctgaggtttgggagatgaatgatccatggccctttttatatagtttgtcatttaatccttggaccattttacaaatgaggagcctgaggctcagagaagttaagcagcttcccccggaaaaccaacttggtaagtggtggagctgggattcaagcccacatttgtctgattccagaatcttactccaagtctgggcaaggcgtgggctggccaggcagctgcctgaagggcaattgtctataaccctggggtcagggggatgagaaatgtgaggcctgttaacccaggtctctgggcaagcttccttatataacctgcacattgtcaacgctccactcaggcagctctcccattccttactacataattattagataatgcataagggagaggtttgaatgactagcctgcctgggaggctgcctctctacggtcctgcttccaccacacgggagccctgaaacgagcaggccagctggagaggtggccaacacattcctcacccagaggctccgggctccccagatggccactgccacctgaccacacagagtcactttgccagaaggactgccctgctttaggcctgatctgatctttttccaggaaactcgtctggtgtaagatttatgtgtccaaacttgccagccttcccctttcaccctggactaacagggacaagaattctaatcaatgtgcaggaacacagaaaaaaaacagggaaacagcaggcaggcccaaccccaaaagccccaaacttatttcccaattttgggttgcacatgtatttctactcacataagacagtttgcatccaactggggggaattttgagtttcaattaaactttgctaaaatacaaaactcatttccccttaactgtgcttcctgacaatgaagtggtggtgtcacggggcagaagggctgatggtgtgggttaccacagcaaggtccatgctgcaaagacgggctgcccctcctgctctgggagtcaacgcttcctgggtccaccaggcccagcatttccacaggctgtcatcggtgtgtccccagcacagcacctagctagatctcagcaaatgatttgaatgtgtggggctccctccaggtaagaaaggaacccctgctcacggcactccccagaagtccttggtaactcactttctctttctgttctgaacatccattcgggctggtttaaagcacagctcgctcaagaggcagccctccagaggagatcggggttaattacgtttactgacagctgtcttctttctcctacagtcacttcttcccatgtcctgatttcattgcttgtgaaaagagatggccttccaatgggaaaaggcaaggagtaaaactcacgagagaaagcgtcctggagattttaaggagaaaggcacatcggttctgccagcacaagagctgcctgtttccctatcagatatcaacactcatttagtgcaagggtgaatatcacctttctattgaaaagaaatagagtaccctaggaaaatagcttgcatcaaaacaagagaaaagtaggttctgaaccagaactaaaatatttggacaccgaagctgtgactactgatgcaaagccattaacccataaaaacaaacattcaaacaagacactgcatagctctctttaaatgagtccaaacaccagagctttatcttaaaacaaataaacaacaacaacaaaaaattcctttccccatcccatctccacccacccactaggagtaaaacatattgctagctctgagacttttctaagaacttggtcagagacactgagcggctggtcaatatatttcttacaaatggggctttgagagcggaactagcagctgggtgccaagaacacagtggctctgctcacatctcacatatgcccagacgctctgaaccacagcctaccactgctgccacaggttcaagttctgaaacccaaagagagcacagagaaggcaggaagagaagaaaaaaagacccagatgttgcaaatcagaataagtgctgagtgaggcagtatcatgacatggcaacgataaatgttgaacgttggctctcctcttgtcagctgacccctctgctctgggacccttcacactgtgactccagttaaatcaaccagctgtgcctccaagaaaggcagcatgggtcagtgtggctgcctggactctgctgctgacagctgcagagagaaactcaaaccagccacatagcctggcccaccttatagtctgaacgtgcccagccaaaaagaagaaaagaaaacagctcaaaaaacagcaaaggctgggtacggtggctcatgcctgtaatcccagaactttgggaggttgaggcgagcagattgcttgagctcaggagttcaagaccagccagggcaacatggtgaaaccctatctctaaaaaaaaaaatgcaaaaattagctaggggtggtggcacacatctgtagtcccagctactcgggaggctgaggcaggaggacagctagtgcccgcaaggttgaggctgtagcgagccatgttcgtgcaactgcactctagcgtgggtgacaaagcaagatctcgtctcaaaaaaaaaaaaaaaaaaaacagaaaagcaaaaaacccacagctgagaagcctctggctcaaacccacatacagaagcttgtcggctgctgtgtgtacacataccagccaccatgatcctggccttctctgaccattggtctgtaaggaaataaggtgataagtgggaactgggctctgaaccctggaactgagaagtcaggctgctgcaaaactctccaggatattaatccctctctctgcccagtggttttcaactgggggcagtttagcccccctagggaacactcatcaatgtctgaagacatttttggttgtcacatctgggggtcagggggttgctatcgctacctagtgggccctggtagaggccaggtttgctactatacctcctacaatgcccaggacagctctcacaacaaggaatcatctggcccaaaatgtcaatggtgccaaggctgagaaaccctgctctagagcctaagagtgctgggctcaaattctaacatcactgctgactagcccaggggcctttgtataacttacttcacctgtcagagcctcaggtttatatatatgtgtgtgtgtatgtgtttgtgtgtgtgtatatagatatacatatatatttatattcatatatacatatttttatatattatatatttatatattaaatatgcatatttatatataatacattatataacatataatatatattatatatgaatatgaaaaaattatatattatatattatatatgaatatgcatatataatatttattttttatatatatatatataaattgtctttctgagacgaagtctcactctgttgcacaggccagagtgcagtggcatgatctcagctcactgcaacctccacctactgggttcaagtgattctcctgcctcaacctcctgagtagctaggattacagacactcgccaccacaccaagtgcagggattacaggcatgagccaccatgcccagcctattttatatatttaacaaaacttatgtagcagtttctaagtaccaggcactattcaaagcagttcatacatattaactcatttaatcttcctaatcaccctatgctgtagtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagcacgctgcaagagctcccttcctggccactttgcagaagagaaactaaccttgcgcagcaagtcaggaccctcccccacaaccaccccccagaaaacacaacagtctcacaagttttagtatggtcgcgtctgtaagcaaaagtaaggaagtcataagataagccccacgctggaaaacttgatccttttatgaaaggatggacaggctcactgattcaggtgagaaagaagcccaagtcctgagaggtgcagctgctgaagaccagggtggccccaagcaggctatgtgcaggctcccctgtcctctacctctcagtgaaggatgtccaggagatcccactcctttccccatgaacccagttcccttccatctgcccactttggtctccctgcacataaactcatctccccctacacactccacgtggtctggccccagccttcattccacccattttagtagactgcttccacaatgggctgttcagatccagggggtccaatgttcatatcagggcttcaaatgacctaacattaccagaggcaaaggtgcttaggttaaccaaaaagcaggaccagactgttggcaacccagtgtgctaatgcaggccacccaggccaatcagaagtactgaccagagaaaggcacatttcagactaaataaatatttatcttttttgaaattacttaaagattgcaatttgtttagaggtgtaactggaccccccgcaggcccaagggaaggctgttctagctaacggtaaggagaggagtagaaggcaaggtggaggagggccttctgaggcaggaagtgaggcatcaggacagggtgtggctgggaacatcccccaggaacacatcaagtgactgataaacatttatttgctttatattaggagaatgagaacacggcctatagaaaactgggagtgctaagggcaaagaaacggcttaaagacagagagactatgtttgagcaaagtgagaaaggccattcattggtaccctcagttattaaaataatatataattcaccgctaatcacggcactgcccggatgaatattaattgaatattatatacaacatattacacactgagtgactcatagttacttctaatgaatatcaatatattttgacacatttaacaacgtggagtggtggagggggtacttctagagccaggcttcctaggtgcgattcccagctctgccacttactagctctgtgacatgtggcgaatccctggacctttctatgcagcagttttccactctgtaaaatgggaataaaaacaatgtctaccacaaagtaaaactctcaatacatagtagcttttgttttttaaaaagcttcaggattcaagttgatgagtgaaatgtatgggcatcaaccagattatgagcattcctcttcttcagaagttagtgctgaattatctggtccttccttaaccactgtgaacttgcgtggtgtccaaagacagaacctttcctgtcaacacatgtggaggcaactgcattaggtgcccggcccactgcttttctgactgccacttggccagagctgaaattctactcaagtctgtgagtgaggcccagctcctttccaagttccttgtaatcccactcaaaaaggcatgctttttacttttcttttctttttttttttttttgagacggagtgtcactctgtggcccaggctagagtgcaatggtgcgatctcgggtcaccgcaacctctgcctcccgggttcaagcgattctcctgcctcagcctcctgagtagctgagaccacaagtgcgtgccaccacacccggctaattttttgtatttttagtagagatagggtttcaccatggtagccaggatagtctcaatctcctgacctcgtgatctgccttccttggtctcccaaagtgctaggattacagttgtgagccactgcgcctggccaaggcatgctttttaatgaactccagttctcctgtctcaaagaggtctatcacatggtctttggaaagaagtggtccctgctgtgacagaggatcctgacagcagtcatggagcgctcgttaaagaaaaaaatgattcaatggcgcttgctaacgaactatagggcaagctttatttagggaaaccaccaagattggtgtagggaccaccacagtggtgttttgcagtcagggagagagattgggatcaactccaaatacaaggaaaagtgggaatgcatagccaacgagaatggtgaaggtcagtggatggaaaattactgcagaaacatcagaggtaaggggggattctggctaaattggcctaacaggattcttgctgaaggcaggcaggttgaacagacatcacctggggcacggtagaggatgatgctatggtctgaatgttggtgtccccctaaaattcttatgttggaacctaataccagtgtgatagaatgaagaggtggagcctataggaagtgatgaggtcatgagggctgggattagtgtcctcataaaaaaggttgaagaaagcgtccctacccctccaccatctgaggacacgtagaaggcatcttttctgaagaacaggccctcgtcaacactgaatctgctggtgccttgaccttggactgcccagccgccagaatagtgagcagtacataaattacccattctaaggtattttgctatagcagcaggaacagcgtaagacagatgaggaacccaatcagatatcaagggtgatcagatattgaggatggaggattctgtctaaactggattcgtgctacagttggacagagacaaacacagaagctcaaaagttgacccctagttgaaaaaaatctcagaagagcctaacgtgtggtcatggagagaatctttgtcaggccccagatcaaggacagcatgtggtgggtgagatccacactcttagggagaggagatgctttgaatgacctaattctttattgctgggagaaggaggacccagggtagaaggaaagacctgagagagagggagagagagagagagagagagagagagagagagagagagagaggtgctgggagaaggaggacccagggtggagggaaagggcagaccagagcctcagagcctgccatccccactggcatcattttgctctcacagggcccctgcactctgcacaataaaggagttgtttaacctcccagcatcctgggggcaggaaatattggtttcatctatttgttgtttgtttcagtcttggtgcatcttggaaccaaagttctcactgtatggacacaaaactaatttaggttcttttaatccaacataagaaaaacttagtttcctctagccaccatcaatcaacacaaagccaacagggcggaagggagggcccttgcttcctggcagtctccctggagggggagggggcaggaagtgatctagaatccagtctcagaagaactgctgacaacaccctcaccaaaacgcatcatcatcttgcactcatctctaagtagtgcctcccacagcctaagagcaaaggctcataacttctatccacagggtttctgccatttaccattacctccctgtcctggctcaggcaaggaccctcagggctgagatgcatcttcaggtcagcctgcccacatgtaaacagatgatacatgcacacgtgcgtgcacacacacccacctctgcatgctggagatacacaggacgtggaataagtcctctctgagaatttacgaaggcacctggctgccatcagcacagagtcatcctctgtctgagttctgaaggtagcagtgtctctgcaggtaggaagagagacaaatggagcttccttccagctgaagcaagtagaggctttgttttctctctagagggttgtaagaatttattgttttggagaaataacataaaatctaagagcgctggttcccaggctagaagacagaccagatctattcattcagcaagcattaaaaattcactgcttaattaatacaccaattgctccctccttgcaaagaggaagaacagttcagccccatgggctggcatctttgccactgaggtctgcacaagatgcggatggtgaacacatgctacggccattttggatgtttccttgtagcatcaatgaggaaagaaaacaaaactgttaaaaataaaacctctgccactatatcctgaattatatcagcaagctcctttttaacaagatgttatgtccaggaaatgtatccatttactgattgttcctgaagaaataacttgttcactaggaaataacttaaaccagaaatgtgggctctcatctgatgtggtttatgcatctctaggtgttttcagtgtctcttgtctatttaatggactcccagaagagtaggatgtctacctaaaaagaaaaattaacgtttatactctcctgatgatgtttatgtggaagaaaacaaacatttgtcaaatgtctgttttttattttatttatttatttatttagagatggagtttcgttcttgttgcccaggctggagtgcaatggtgcaatctcggctcactgcagcctctgctgcccgggtttaagcaattctcctgcctcagcctcccgagtagctgggattacaagtgcccgccactaggtccagctaattttttgtgtttttagtagagacggggtttcaccacgttggccgggctggtcttgaactcctgatgtcagctgattgtcactcatccattatacatcatttaatctgccatgagcttaataagcattatagagtctaatcacctaatgagcacgctcatgaaagtgtcaccttcattgaatcatttaactctcctagtagctctatgaagtactattattaccccccagcttataagataggaaactgaggctctgagaataatctgcccaagatcctgtaagtagtaggtctagaattcaagcccagcctgatctttctccaaatctacattattgtccctgaaccaaaacattctcaggccatgatcttctcccctgtcagcagaatctggagcatctcagggttcatgttgaattacaaagccctgccctaaagcagatttattggaagtccagtgcttgtgagagttattctgaagggaaaaaaaaataaaatacatatatatatctcagaaagccttctctgcccaggccaatgcagccagctccctgcttaagaatagctgcccatgggcagggtttcctggccagcaattcaagatgtgcctgtgccggctttactctttaatctcagtttcctcacctttaaagtgggtcccacaagccctgtcctacagggctgctataaggatttaatgtgatgagaatcctaacatagctaacaaagtgcctggtactgggtggtcagtaaatgacagttattgctgctattacttggtagactcccaaaagttattctcacatccagtggagggaagaggagggagcaatcctcccttgggggtagagtattttgcatcaacaggttttagaatttttggtgcaaggtgagagtcaaaatctaacagacttcgtttattatattattgcttttacgttctcttcagacaacgtacccccttattgcctctccctgggctgggcctctctatcccttccctctccccactccctgtgctcccacctagatctcttccaaatttcccagtagagagggaatagagaggcagtggtggtatctttcaccccacatcccagtggtgatcacagcacttcagggaaaaagaaagcagccttcacacatatgggcctccctaaaaagcttcccaggaaaaaggaaatgtgtgtggaaaggccataactgggaatgaatcatctgttaggaaggctgaaggagagggagaaaggggagtggccggaggtgaggctggagaagtaggcagggcccatcgcctggggtggtgcataccttgggaagaattttcaattatctttagttcagcaagaaattacagacatgattagggcccatgcaaacattctggaagggtcaaggcaggatgtgggggaccggtgaggaatctcctgcagcagtcaagcaatggtggcctggagagggagtggacgtcaggatggataagtggatggattcatgcactcgtccttaggaggaggaatgcacaggacttggtgacagcttaagtgtaacaggtggtggagaggagagggtgaagtccggcttctggcccaagcagcttgggggacagtggtgccccttcctaagacagggtgcatctgaagaggagagactcacaggctgaggaaggggctggggtgtgggttggtcatgcatgtgggaaggtgctgagccgagttatgcgtgtgttgagtcatctaagtggagatgctaagaagggggctgcatttacaatcagttcttccaaagaggggtccagatgagatgcatggaaactaacaccaggggacgtgacaccttcacctaggggaagactacattgtaagaagagaaatcctcagacagagtctagggagctgcgatcctcaatagccaagcagaggggtggtggaggcagcagagaaggctatgcaggagaagcctgaaaagcagagagaaaaccaggagaggctggtgcctcagaagcccagggaagaaaacaagatgcagagttttaaacttcacaaaatgccactcagagggcaagaaagacaaagttaggacaatgtcactggcatttattaagacgcaggtcagaggtgctcttttcaggagcaggtgtggctgggcatgcaagggctgaagcggaggagggaggtgacaccatgcacacagcccaggaggctgcctcactcacaccccacttgcttagccccactcacttagcctatttccttcacagccattatcttaatgtgtgctgtcttgcttctttgtttacttgtgaattgccttcttcccttaaggtctgttagggcgagctccttgtctgctctattcacagctgtaccccagcacctaggaggatgcttgacacagaacagggattcaatacctgttgggtattgaatgaatgaaacagaagcagagtaaagtctggctaagaagtgaggagggggagagctgcaaagcccagaaactacccacaagaatgagccagtggtgaggaggaggggtgggttactgtccctgggaagtgggacccccagtttaagtggaggcttagggcagaatcctggacactaaaaggaatgcttaaaagggaatttgaggcattttctggtctgaaagacatccggcccacattgctttcacttaggtcatgttcccccaaaggaaatcctgagataaggattcctagatgagtgattcattgaagaaatgtccccagagtggtcggtaggagagtggagaagcaggacagaaaggggagaggccaagccaagcatgacctcaggccacatcccagcctcagcctgaccccagggagggtcctggaatgtaaaccgaacctcctgcaagtttgtacacccccaccccccactgccagggcaaggtggctgacctttcatattcccaccctaattaatattggctacagactgtcatggccaggacagaaactcccagccactccaactctcttggcaagagggtaatcctttgaagaaggcgatggggcaaagctttagaaacagaggctacagaagctgcaggatgggcacacagaagtggccgaagtgatccaacgccatctgagcagagcgccggcaatgtctgctactaaattgggatagagttttttatggattaccctggaagagcacaccaaacaaaccacttcattctgagggcctggacggtgcagggatagctaccatttagaatcgtttcagtttctattccggtaaagaatccttcaaagaaagacatcgaggctcttacagtgcagagaggtgctcttcttggacaactatagggtgtgaacgtagcacagctactaaaagtgaatgtgacacaacaattaagagagtatggtgagtatttagaaatacttagaagtcaaagcataaaaaactggataacttgggttacattcctgagacatgtttattattatcacagtactgtgatattgtagaatctggagaaataaaatcaattgaaataaaataaaatacatctaccaactaccatttactgaacacctgctatggatccaactctgtgctagaaatgaagcagcatctcccttgctcaaagctgattttcaggctgggaactagatggggctcctgaagcaattcaagaacaaggcaaaaacagatctatggaggtcacataggatgatgattaagagttgagccaggctcagcaactgcctaggatcactcccatttctgctgccagactctctgtgcctcagtttccccatctgaaaaattgagatactaagagtctttacttcacaagattcctgtgaaggtaacaggaggtgatgtgtgcaaggtccttagtatggtgctgatgaatgcagtgagcactgaggccttgttattctgcaattattactggaggtgaggctagaaaagaccacacttgcccgacttgtcctacctttctctcctcaggagggaccaagacatttatgcctggttatgaggtgacattagaaaagaaatcaaaaagcatctgtccttgtttcttgaagccagatgcaaccaagctaagcctgaaccaagagttgatgggcagctgggtggtgtgctcctctgttgagctggccaggagctaaggctgatggctttctgtccagggagccgtttagactcagagtacacacatgcttgcctcttaaaagagtattgggtcagcaaggatgcactgggaaagccatcagcatctttgcatccctactgaccatttcctgcccagcacactggagccagtgctgaccattttcctttttttttctttttttttttttttgagacagtctctttctgtcacccaggctagagtgcagtgatacaatcttggctcactgcagccacctcctgggttcaagtgactctcatgcctcagcctcctgagtagctgggattacaggcatgtgccaccatgcccagctaatttttacatttttagtagagatggggtattgctacgttgcccaggctaatctcgaactcatggcctcaagtgatctgcctacctcggcctcccaaagtcttgggattacaggcctgagccaccgtgcctggtcctgaccattttctgattggcagcagcaggagggccccagggtcaaacaatgcagtcacacaggcctgtgctttaactgtgcctccccacacagcttggtgaccccgggccagtgactttgacctctgaagcctcaattcccttgactgtaaaagaggtcctgaccttggctgcacattaaaatcactgggggagtgtttaaaagtccaaatacccagggcttgcccagaccaacaaaatcagaaccccctgatgagacctactgctgtaaggtaaaatggtcatcttctactcccagaagtggaattaagggagactatccatggaaggtgcttaccgccatgctttacacagagtgcgccgtaaaaggaggccgtgatatggtaccatttggagttcccagactctagaaacacctcccacaggcccacagaggattgtacttgaaacttcattcattgtactttatgccccactttggtgagtatcaaagatcaattgtgcattttgatttctctagttcttttgatcaccctggtccacaatcatgttattcttcaagagagaaaatggccagacccaggaagtgcttctctggattaagggctgtgaggttaaatctttgtttccatctctgccctcaaggacctccaatcccccatcctaataagagagctgccatccacaagggtccttggcccttggcttgcagaagcgggatgagcatctacaaccctggctgtgatgaaggctgccctgacagttacattcttgatagagttgcaggacaaatatttctgaacctgtggttcctttgccgtgtctctagtcaacatagggcttttagccctgtggaacatgaagatttttgtgaactagggtataaggatttaagagtgtaggtggggcctctctaggccctgcttcctacatagttgatgtgtctggacccacaactgagagaaggaacaaagcaaacaggtgggatcccttatagtttatagttatgtttttcagagtaacagacattcagggaaacagaaacagaactttagctcaagcagcaggagggggcagccagcatctgagctggaagaagagctagcaggtgacaaaggaaacaagcactctccatgcagtgttaaggcagtgcttatcatccagtgggaactggggtgccagggtgccaggcaacagagcagttgatggagacagttccagtgccattatgagctgttaaaaggggatctgacgtgtgcattccagaccctgatactacttcttgtccagtcattcaacaacatagtattccctataggcccagcatgtctgtctatgtatctgatttcacaatcccatgacataggtactgttatcctcactttgcagctgaggagactgaggcacatagaggttaagtaacttgtccaagatcacacagttagtatatgacagagttgggatttgaaccctgtgctcttaatttctatgccaaattgtctctagcttagtgagggtgtcaaacaggtcaacagacaattagaatatagtacagtctaagtgactgctagggactagcacaggtggtggcatccaaaatcccattcttatctgatgctcactcataggaagaaaaacagaagtacccacctggtgacaggctagcaggcacaaggatagacagaatgtgcacctgaaggagttcacctaggagagctgaggaggcacaaagacctgcatgtgagtgttcgtggcagcttcatttacaatagcccaaatctggaaacaatccaaatttctatcaacaggtggatggataaaaaatctgtggtggccaggcgcggtggctcacgcctgtaatcccagcactttaggaggccaaggcaggtggatcatgaggtcaggagtttgagaccagcctgaccaacatggtgaaaccccgtctctactaaaaataggaaaaatcagccaagcgtggtggcatgcacctgtagtccctgtaactcaggaggctgagacaggagaatcacttgaacctgggaggtggaggttgcagtgagctgagatcgcaccactgcactccagcctgggcaacacagcaagactctgtctgaaaaaaaaaaaatcctgtggcatatccagacaatggaataccattcagccacacaaataatgaattgctgatctacacaacatggatgaatctcaaaagcaccatgctaagagaaagaagccagaagcaaaaagggtgcatattttatgattttagctatatgaaattctaggaaaggcaaaactctggttttagaaaacagagttttgcaaggggatgggggtaggagggacgaactaagtgtgacaggcatgaagaaactttacgggatgacgggaatgttctatattttgatggtggtgatggctacactggtgcagatacttgtcaaactcattaaattgtacacttcaaaaggtgaattttattacatgtaaattatactcaatttagaaaatattttaacaagagacttgatgtcatgcagtcaaaagtgaactgtgctatgctctgaagctaacggtgagagttacatacgttctgcttcctttgttttttgttccttgttctttctttccccctttccttttttttttttttctctctctctctctccctcctttctgtctctcctcaaagtctaccacctccttttccaagccaagcctaggtgacaggcccctgagctgcaagtgtttccagcactgccattacaaattagtggaaatgatcagacccccaggcagactggttctcagcctgcttcagaggggcagatgttctgcaaaaccagccagtgacccacagagaagactggcaagcccgcaaggctctcattggacccctctgtggcttctgcctcccaggtagaaagcatgcatatattagatttaaaaagaggaagtgcctttccaaaaactactcggctttgggagggatagaggtcatttgtctttgtccaagaaaaacatgttccttccttgtaatccttgataacccctgaattgttttctccaagatagttagggacaggggtaggggagaggggctacagtaaaagagaaaaggaggtagagaggacagaggaagccaatgccctactactctgcggtagcagcaaggtgagctcttaccaccttgaactctgggaaagatggtaaaagagggaacccttcaccaaccagtgcccacatgactacctaagacagcacccatatgaggtgcaaccatatgaaggttcacttctcgctggatgagaagtgaacagagaggttaacagggcaaagaagcagcagtaatgggaaaagaacgtgagactggcacggttccctcccctgggcctgcgggaggcccatggcagccagaatgtccatctgctgtgccccaccactagtaggctcacaggaagggaagagaacaatgacaacccaactgtcccttgcgcagaagttacaccaagaagtgagcagcaggacccgctggcctggcagtaaaccacatcagagttatcagtcggaaacctcttggacaaagagagtttataaagtcccttggccaagaggcatggaagttgagttcagccaagcgcaactcagacacatgggcaatggaaggggagctggggatgccagctgccatccaagtcctgtttgttggaaattgagagagatagtattggagaactagatgctttcactttatttctccaaaagagagctggtctccaggtggtgaagcctataattctataaaaactggagattggagagataggagggtacaactctggcccaagacagaaataagcaaaaacaaaacaaaacaaaacaaaaaaataggcatccataagagaaaaaagtgagtggttctgggcatctagtaagtggaagaggaaagagaccatctctaatcctaactcactctgttccaggtttggaataaaagctgtatcgggagaaataacctgttaaagtagaattgtcaatgtgtagaactgaaaatcggccaaaaatccatcagctttctcaatttactaagaaagaataattaactccctagtacctgatatacttttgcatttaaaggctaaactacctatatctactcaatatcattcacttctagtaagactcttattggcaggtttaaagcacccctacccaacccactagcaccaacttgtcttttatcttagcctggaaagaacatgtatgggttacattactaagaacatagtatcattgaatgaatcattaaatagaccagtcactgtaataaatacatgtggatatatacattctgttaatagacttggcatagtctttcatggtttcaagtgttaaggtttattgtggtattaaagaaaaccttatagactttcattttctgaacgatagtggattcaatatatagccaactctactgaaaacactaagcaaactggatactatagaaaaactcttttgaaatgactgatgagctggcaagttagtaagacgtattcagtgagcaaaaactaagcaaaatctgaagcctagtataagagccaatccctgaagctagcttgaagacaatagccaacaaagtgaccttcacttttatcttttgtggcctcacgggaagaggagacaggataagaatttcccataacataaaggatactatcacatggatccaggaactccaatgaataccaagtatgagaaataaaaataaatatatacctagatacgctttgtgaaactatagaacaccaaacaatttaaaggaaccagaaggaaaacacagattattctcaaaggagacactcttgtctgtagacaagacagtagattttagaggcaacaatggaaacagaggacagttgaataatatcttcattgtgttggagagaaaataactggcaacctagaattctaccctaattctacccagtaaaaacctctctcaaaaacaaggggaaaaatagtgtatttgcaagcaaacaaaatcaagaagttgtcaccaacagaccctcaataaagaaaattctaaaagctgtacttcaggctctattggaaaataccaaaatgaagttggtagacctacattaatattaatcagaatagacttaaagactaaaagaattactaaggaaacaagttttgcttaattataaaagattcaattcaccagaaagataaaacaattcaaacctataggtacctaataacaaaggctcaaaatatataaaacacaaactgacagaccataagaagaaacagaaaaatctacgatcatagtgggagattataatacttctctcagtaactgattgaacaagcatacaaacatcagtaatgatataaaagacttggacaacacagtgaagaagcttgatctgatagagttacatagaacactgcatctaacaatggtaggatccacagaacattatgaaaagtgaccacataccaagccttacagtaagcttcaataaatttaaaaggctgggtagcactcaaacaatatttgacaaccatgaggcaattaagttagaaattagtaacaaaaagataataagaaaaataaacaaacattcagaggattaaaaagaaacacagctttaagtcataagtcaaagaataaatcatagtgaaaattataaagtactcagaaccaaattatatacaaatattacatatcaaaatttatgaagttagagtaaatattgtatagcttacaatgctcataatggggaaaaaagcctgaaaattaaaaagccaaacacttaccttaaaaagctaagaaagaaaaatagctcaaatgtaaataagttagatggaagaaaataataaaaattagtatagacattcataaactagaaaacaaaagatggagaggatcacaaagtcaaggattagagatagtctctaataacattgagaaaattcttaaaagaccatttaacaaaattatagaaggtattacaaatgaaaagtggacataaccacagatcccacagaacattaaaaaataacagcatcttataagtagcttcaaggtaaaaattttgaaaactcagataatatggataaatttctagaaaaatctaatttaccaatattgatttaagaaaaaaattaaaacctgaatacccatgatctattgaagaaattgaatcagaggttaaaaatcttcaggaaagaaagaactccagcctcacagaatctttttttgagaacagataaagaggaaatattctataacttactttacaaattcagcaaaaccatgatacaaaaccctgccaaggataagataagaagtgcaaattacagtacaacacactcatgaagatagatataaaacttctaaattttattagcaaaaaaacctagcaatgtataagaaatgaacccattacaaccaagtcaggtttattctaggaaagcaaggttaagttaacattggaaaattagtttaccagatattaacaaattaaagaaaaaaattatataaatctcaataaatgcagaggaagtatttaataaacatccatgtatataatttgaaagaaaaaaagctctttgcaaactacagaacaggagtagttccttatcctaataaggaatatcaaatccataaaaactctcattctcaagggaaaacgttgaacatgaaaggcaaagcttaaacgtttagaagaccatacaagaactgtccttaaggatgtcctttaaaagacacaaaatgttcaatgataaaggaaagattgataaattttattacattgaaattaagaatttctgccactgtaaagatactaaaaaagatggtgagaaaaaataacacaaataaggagaaggtattttggcaacacagagaaatagtctcctgcatatataaagaactcctacaaataaataagagagatgtaaactacccaattttcaaataaatgggcaaaaggcttaaagaggtacttcacaaaaaaagaaaatccaaaaggtcaacagcgtatgaaaagatactgaccctctttagtaatcaaatgtatataaattgaaagcagattagatactgttacacatccacaagatgggcaaaagtttttgacaatatcctacaaaatataaagtttttgcaagattagagagcagtaggagaaattgcagctggatatagaaattggttaaacacattggaaattaatttttgattaaagtgaaactcatatgacaccatagaattctgaactatcctagcagcactgaaaatgcccatagtctgtggccagtaattttattactatgtgtattccctaagtaaacttacacacatacttagcagggaacttgaaaaaaaatgtttacagcagcactatttataatagcaaaatactggaaataagctaagtgttcattaataatagaatagacatataaactgccatatattcattcaatggaatattatggttcagcaaaatgaaaaaatttcagctacacccaacaatgtgaatgaatccaggacgaaacatttaacaaccagttggtacagagtccaatcaaatgaagtcccagccctagtgccagagctggtacccaagaccccctgccatgccaggtgtaatccctttagaaaggagtggacttggagaagtaccataggagcacctgggaaagacccaggtaagcagcaatttaccaactgatatggaaatattcccattgtttgtcaaccagtgagccttactggtgtggtgtgcatggactaaacgtgagcattaagaacaaaagaataaaacagtgtgattccatttatatgaagttcacaaacacgcataactagacaatatattgtttagggatacaaatgcaagaggataagacaataaagaaaagcataggggaataaaaggtacagaaatgtccagaagatggtaatccctgagaagagaaggaatgggatagggtggagggaggtacacaggggatgtcaaaggttcaagtaacattctttttctcaaattgactggtgagtacataagtgttagtcataatgttattctttagacctttctacacagtttgtaagcattcgtttgcatctaggggctatttcattaaagttatttcaaaagatggtcacaacacaaatttaataagaaactctcatatcaaattgctgcagttcctgccatatcttttctagttgctgggcaaagatgctctcctcaattgtaattggtgtgctcttaaacccacttaaaattctaagagcttctccccagaccactccaaaacattcttgtgagaatctttccagtgaggtacagcaaggcccaacctccagggcacattatgctctggctcatttatttgatacaatcataatcatagtgggtttttttctcaaactttgaaatcttcaaaatgagggcatggagcaaatgactacattctgcttctcttgctaagatttcaatggtgatgctctcattttaagttctttaccagacgcttcagctgtgctatgcccaattcccctcatcaagatttgctgacagtcaggggaagtttctaacactgtattaagtgtatactgagggccagggaattggggggagtttgaggggctgcacacatgtgcaattttttagcaaacccagcagatgcttgtagattcaacactttttcagttatttgtgaacaacccctaatagccacaccacatggcaatttgtcttttctctggagcacaaatgtgaactgtatgttgcaaagccacagcaaagaacaagtcacttagctagagagggagtcttctcaaagacccagtaaccccatcccaagatgccaccagggaaacagaaactctctggaggtgaaagaaacttaatttccttgagtgcaaattgaaaaggcaaataattggtagcctgtgaatagtcataggaacctcttcactctggaatggaacctgattcaggaggaagtcaagagcctatgcaaatatttctgcatttgcaaacttggggatttgccaagggcttgagatgtatccactgaaaatgtcaagcgtctactgtgtagaattttgatggaggaggatttcaaaattcttcttctatttaaatccaatcaattcatgtttatcagggcatctctgatctttttgtttttaagagacatatttgctctattgtccaggctggagtacagtgatgtgatcatagcccatggcaggctcaaactcctggactcaagagatcctcccgcctctgtctcctgagtagttagaattacaggtgtgagccaccatgtccataattttatttttattttttttaagacagggtcttgctatgtcgcccaggctgatctcaaactcctgggctcaagtgatcctcctgtgtcagcctcctgagcagctggcattacaggcatgagccactgtatccagctcctctgatcttaagatagtttcaacatctaatgctaagcctggaagtccaatgaaagactcaatagactaaaattggtgactgagattcggaggagcatatcgtgtgtttataacactgcttttattttttccatatctttctactatttgtttattagcttttctttggatctcagttattcatacataacacatgtttaaaaagttgatcctaaaccccaattcaagggtccaccgatgctcagagatctcaagatttctgagactagcttccctatacttctccctggctttgctccccaaatctgaaaggcattttcagatcacccctacttcatatttagatataaagcttccccctttatccacaagaattccagctgcacctggcatttcaaaaacacttagtaatgaggaggggagacccatcagtcatgtactcaccacttccattgttgtcctgcctcccaagcacatatttccaactgtgaaacctcccaacagggcagtcctctggatagtgtggttcagtcacttcccaccaccatgcctcacctcctctgccttccaagccctctgggacttcagggaataccttttctccatcatattacaattagatacagggaacctttggagagttctgagtatttgtgattatattcaataacctgttactgacagtttcttttagttaaagaattttttcaagtaagttaccaaaacaatgaatgtatgtacatctagaaactgagaaatactcttccatgacttttagttaggtcctcacgttttccacatatgtattgaatttttaaaatactattttaaaagggtctacatttattttcctctacttttgtttttcctcttgcctttgttttggagcaaattttaactgaacacattgtcagagggtcaggccaagtttggcactgctcgtgtatctcagccaccttccagttttcagcacgatgtctgaactgaaaaaacaccattgcttaccataagggtgtggccatgacagcttgaacaacatccgggtagtggtaagtctacatttgctacacagatgtaagaaacagatagcagtagggtctacctctcctgctccatcttttccatcaccaggtctcttccaactccagaattaaagtcatcaagttggaacaactctaagtgtgtttcctgatcataacaagacaggttgaggttcatgaatattttctttagtattaaatgttagaacataaccactaataataacagtagcatagtagttccctgataaattttgacaaaagatcataaagttctcaatttcaacagcagggctttatagttgtaatataattttgaccagtaagccaccggctatccagaaacctcacaggtgccattatcatggatagttgcagttttttctctaagaatcatgcaaaaaaaaaaaatcttttggggatacttcagaactctgtctttttaaattggatgaacaaaatataattttaacttctatggatacatgtgggtcattgtgagcatcagttactatgttataaaacagagtaccaaagatccatcaaaatacataaaatttcactgaattgcttacattaaatgctcatatcagctttagaattccatgccttgaattcttgtgccttttaaatttttttttagtttttctgttttttactcttacttcttactgatacttgataaaagagctttaataatccttgcacagtacagtatcagttgcttccaatttgctaggtgcatttgacaaactaataaccaagcctcttaaaacttgaagtaaatgcagaggcctgaaagagggtataaaatttcctccaatgatcaaaattcataaactgtagctcatggacttatgacctttctcttgatttgccatctaggtcccaactggataagtgaaattatgtaaatgtgagttccagattgttgtggtattatcctaatacctatcaactacatagcatgttactaaacgtatctcatttttcttctcaagatagttcagtggtcttggtaaggttatgatggttacacctactttacagataaggaagaaaattggtcacgggctttggccaagtctgacccagaatgctagtgctgcctgttgatacagccagtgttttccagccctgcccgcctagtgcatctgcagatttgtaaatacactttgactccacaggaaacaggatggagaacagcatgtcagggactccttgatgggcaggatggagggcaaaaaagagccttaaagacattagggaattcacagagtagggagtgagagacaagttaaatgctatccagttgtcacacagctttcttaatgttatctttcatcaaatcatgtcctagaacctgccaggacttcagactaaatgcatcttcttcttgcctgtacctttcacacactaaatgtctcaacagctcacttggcaaggacccaaaggcagcacacacttctccactccaaggagggtggctgccactaaacacaatgggcggagacagctcaacaatagtgccagttgagcacatcttgatccactgccacagagttcacagtagtagttggccctcaaagcaaacccactggggtgttgagggcaaaaaaacaatcttagccttaaggggccagactttgccatcaaattaacaaatctgcccaacagccccaggctgaggcgctcaggggtgtgacaggagggcccctgttaacaattctgtatcctgtgggtgccttaactagatggagtggagaggaagcagagagctaagtgtcacaccaccctctcctcctgcctgcaggtgtcttagttggacagctgtccaccttccttgcaaaaaactcccacaatctttaaatgcaactatgtaaagggcctccagcctctgcaagccatcacaactttaaagagcatatgtcaaacagctcagacggcatctgaggtctattcttcagccccacagtatagcccaaccccagagcacaagtgacaccctagtggacaggaactcctccctacactggctgctcagcaggaccatgaagaacagctgggacctggcctattaccttggcttcaggattcattttctgcctggaattgggaaactggaggccctgcaggggtccttctcctgggtccaactgtctccagggtgcaagaggggtgaaattaccaaatgaaagttcagataagcaattactggctgaaagagacacaggagggtcttcagatcaacactgacccagagctaataccacactgtcctcagagggacacacgatcactgacctgtattcttcacatttaagttgctagaattattcctccttgcccccactctctccctgcccccagcatacacataattacataaagacgtcttaaacaactgtagcacccaacttcttcagtctgggggagagccaggagatggtggggagctgtttgggcacacgtctgatcattacataatcacacaaacatgggctggagaacactgccatgcagatcagttcagcaaacacctcattctccctctttcctcttccctccccccgtaacacccaaaatgcacaccagagttaacaaaaccgaagcactccaggtagccagtgggcacctggctgctgtggttacaatgccaagggctaccagaaacgtcagcgtataccagaaagagggccagggtgctgctcacccagcgaccagatctgcagaccctcttcctgcaaccactgcccccgaagttcaaggaagggcctagccacagaaatattcctgacctgcaacagaaaccaaaccagctacgttaaaggaaaccaatgccgagcctccaagttcctctgcaccactgccacactcaggagtcctcagcagcctggacaatatcattagggaccattcggcaccatcagtgtttccatttaaaagatagtaaaatgtggggcataacttggaggggacactctctctgctagcagggaggcaagaatcccctatagaataggagtttggtttgggtttggttgggtcaggttgggggttgggaaatgattttgctttaggaatattttcagggggctaggattaagggggaaaaagaaagctatcccctctgtctcagcagccagcatcatacgaatctcactctcaaccaagcaggctactgcagtccgcctaaacaatccggagcagcagccaaggcagcacaagaaaacgccggtgccacggaacgcgatgcctaagccccccagccgaggctcctatggagccggccgccagtgcgcgggtgcagagcccagcagagcctgctgcaagcagcgctggagcgcacggcgcgcatagggttacagccccgccgccgccgccgccgccgccgcctgtgattgacgcgcgggggtcacttgaggctcgcgccgctccccagcaccaggccgagcagcgcgctcagcccaccgggggcactggccgccacgcgcagcccacccggccggcccctgcgtctcggcagccggacaccttgcctaagaaaggcatacacaaaatggaatcgcagctcgctattctgcttcgcggtgcggcctcaggcaaaaacacaatcacaaggtaaaatacagcgcaaggaatccatccgccgaataaaaacccagagtcccctaccttcggccttgggatggcaaactggtcctgtgttctctgacccacggatccagccccttcttcatgaattattccggccaggcaggattttgtgcatttttttcatgaacacctgtttcaagtaaggggtaaagaccttattgaaagaattgtccttaaaaaataacctgtgcatacgtatgtccatccaggcatgcatgcgtgtttgtatacacacatatgcacacggaatagccatgtacattgaagcaccaaactaggcagctggataatgggagagtcggctggttgtgagcatgctcgcgccgggaacagatccaccctctgttattcctctgaataaatataaatcacgatcagaaacccaaacagaagcatccctcttgaattcgtgctgctgaaaaacacggaataaattcagcctgcagacacagaatctaatcagcagctgttttctgaatccagagccaacccatgcctcgcttgtcttttccactaggagtccagaccttttttgaaagggggtttaaccttttaaagacacagtacaccaattatcacttcggaatagctgtcactcccagcgcaggaagccagtcccatgcctaaaggcacagtaggcttgcacacagtgataaggatttcatttattggtgctttttaaaaaacaacatatatgtataatatatgtgcatatatatgcacatatatatgcacacatattatatatatatacgtggagagaaaaaatgcaaatgcaagtcataaatatttattgcactgatgagcttctcagtactaattggcacgttatgtaaacactatgatccttcacttctgaacacccatgttcacgggtcagacgagacagggcactcttgtcagcaagcgtgtcacacctcaccagcctctggctgcagatcaggggccggggagcctcaacagtgcctgaagggagtggggtctctgcacctgagagctcaacacgggcactccttgccctgccctgccttgctctgcagtctcagggtccatgtccacaaatcaaagaatagttctggcactatttctaaagtcgaacataatccagagccacatcgcattccaagacatactttctttcaaccagaatcaggaatcagaactaccacctgaaccttagttagagtctttacgattcagacttaggcccttcttcaagattttgttattgagttctgttgttttgtttttcacttttcttttaagggtcagcatggaggtatggaggtagaaaaacagggtagggggagagacaacctccagcctaaatttttttgaaaaaaattattcttcgagtacttcagccacccagatggtgtttactgcagttttgttctggcttttaaagaggtagcgctgagaagaaacaagagtcctaaccttgctcacgtgtgttaagaaggcaaatgtctttgacagtttctttttcaccccagccccagagctccagcatggcgctgtctgctcctccgctggttcccgcctaagagcagcggcagtggctcacctcgggagctacaggggcgctcctacagccgctccagcatcacagcccattccctcccttgcctagtcctgccaggcaaaccgtgaaaacaagtgcactgtcaccctcccacctcatcacaggcgctcctgtgtggacccctcccagcgacacacacacactctcttccttcccctcttccagggccctttggcagaaaattatcatatttcatgtgtcatcgcccaagcaagctgggtccatcactgattggctgggccctggcagccggaaatgtcaccagccacacagcgtggagctggctctcccgcggccaccacagacctgagcccaggaggctctgtgacaaggcacagacctaccacagagagcctgtcactctctccctggtccagcccctgccccctgcttctccatctacccagccccccggggaataggggctgcgaggggatggtgaaggagtctcagtgacattcctattttcccagcatgtttgagaagaaactaaagatgtctccaatcaggtttataaatttggagaacttgtttttgacaaaaacattctgtcttcacactaaaaaaaaatcagtaagactgggtgaaaacaagatggtttttttttttttgttttgttttttaccccaggagagtttactagatgctgctgtttatttcccatctaacatctcaggcaccaaggtataatcatgtcacagggctgtccgataattcagaaggtgattcgagtccatcctcttacctttaaagagaacagctccagaaaatgaggctttgtaacttggctttgcaatgtatcatgatgccacacaactttttaagggttaaatgatctttgtagtgaccaacatgaatcacttcagctgtaatttaatcttagtccctcctgctgtatcttcagcaggcttagtgtgactcaccatttaagtctcaccttattctgttctcctgagtaaactaaactctatctctctgtccttttcagtaaaagtttttctcaaccctttaattatgctgctttaaagaaaaagcctcccagagttacatgagtctggaaggtcatttggtccatctatccatatgatgtgtcagaactctccactatttccatacgggggcttttggtttggggaatggtaaattcactggcaatgctgggaaccagggaaagatgccatcaataaagcagacattttgaataatatgggaagatacaaagtagatgggacatgggaggaaaaactaattagtactgataaactcatgattctgcaaagaccctgatatggtttggctgtgtccccacccaaatctcatcttgaattgtagttcccataatccccacatgtcatgggaaggacctggtgggaggtaattgaatcatggaggcaggtttttctcatgctgttcttgtgatagtgaataagtctcatgagatctgatggttttataaagggtagttcccttgcacacgctctcttgcctgccaccatgtaagatgtgcctctgctcctccttcacctctgccatgattgtgtggcttctccagccatgtggaactgtgagtccattaaacctctttttctttataaattgcctggtctcaggtatgtctttattagcagtgtgagaaccgactaatacagacccctaagaagtaactgtacaggtttccagaaaacagtcttggaaaatcccaaactcagagaatcaggattggaggagaatcataggcagcagtttaaaggcaaattaagggacatcaggaacatggtcagtttctccacacagaatggctggacacagaaataggtccacagcttctttggaaagtgagaggtttgttccaaatataatagaagccaaaggttgaataggggcaggatatcagctccttttgaaatgccactgctcttccccaaaaagtgcgcacacacacacaccacacacacacacaccacatgcacacaaaagagatttaaaaaatcagataaaatataagatataacagagagatccagaatatccaatcaatattagcctaataggagttccagatggaggcatcattaatgaagaagaaatcaataatcaaggaaataacagaagaacatttccttaacctgaagaaagtctttaggccttagatcaaatgctgtgctaggcagcaggactactgaaagaatacacacttccagatgtactctgatactccaagagcaaagacaaacaatgacaagcttcctcataaaggagaaaaatcaggttgcttaaaaggaaagaaaatcagactaataccatacttctcatctgtaacactatgctaaaagacactggtataatttctgtagaattctaagggaacattattacaatttaagaattctaccagctgccaaactataatttctcttatgcaatgaaaaagaaaggtatgttcaaagacacagaaattatatcacccaaacaccctttattaaaaaaaatttaaggttacttgaagatctcttccagctgaggaacaaataaggcaggataacaaattcaagaaaggagaagatatgttatataaaaaatgtaatgaataaagccaacaaaatatgtggtcaaatataaaaataattgagaatatagttgtaaaatttaattgttagaagtcttgaaagataagagtataagtacatttattccagatttgaattcacatctatatctatctcttacatatatgtgtctggaattaaacttccatataattataacaaaaaaatagaaaatctcaatggaaacaggtaaaaatcactaaaaaaggaagaaggaaggagggagggaaggaaggaaggaaggaaaggaaggaagggaagagagagataaagaaaaggaaagaaagagaggattgttatggcaggccaataattccatctgtttcctcttcttcccaagaccacattaaaatgaaaataaggattttttttaggttgaaatagatgatgacaaaacaaaaacagtaaaagagtcattgatcaaaaaaattcacaaagaataataaaggaggacaattcatcagttagaaatatatactttaatgctacagtaaacaaaatggtatagtacaaataaagaagcctacaaagtggattgatggaagtcaagaaacaaatttagctataatggttactacatggtagttaagtaataaaaactgaattttaaatcagtggaggaaagaatgtgttattcaataaatagtgttggactgtggctatgtatttgaaaaaatataagttttacctctaactgatatcttgttaaaaatatattctattttcatataggaaattctgccatttgtgaaaacacggataaacctagaggacattatgttaagtgaattaagccaggcacagagaaacaaatactgtgtgagcttacttataagtgggatcttaaaaagtcaaactcataggagtagagagtagaatggtggtaccagaggctggaggaggtggcggggggaagggaaaggagcaacattggccaatgggaacaaagtttcagttatataggaggaataagttctggtgccctactgtacagcatggtgactacagttaataataataatgtcctgtatatttcaaaatagctaaaagagaagattttaaacgttctcaccacaaagaaagggtaaatatgaggtgattaatatgctaattagcctgatttggtcattccataatgtacactatgcatatattgatacatcacattgtacccataaatatatacaagtgttatctgtcaattaaaaataaaataaggctttaaaaatattctattttcacatacacaaaaattccacaagggaaagataggtgttatgattgaccaatactgtaaatcatagaattctatgaagtttttttttctaatagtggaaagaaaagcatgtggtcatccagtctatgcttagataccattgtgataggctaattactggcccccaaagatatctaccccctaatccctagaaactgaatttcaccttatatggcaaaagatgtgactacgttaatgatcttgagatgaggagagatcctggattatccaggagggccctaaatgaaatcacaagtatccttataggactgacgtaggagacgggctagagggcaacgtgactacagcggctgagattggagtgatgcagccacaagccaaggaatgccagaggccaccaggagcagaaagaggtaggaatggattctcccctgagcctccggagggagcatagccctatcaataccttgattttggatttctggcctctaaaactgtaagcagagaaatgggttattttaaataactgagtttgtggtcatttgttatggcagccatagaaaactacaaccaccatgatgagaaacatagtacttcctagggactatcattattattattgccaacaacaatacttactatgtacctggtgctgctaaattatttatatatcttacctcacaagtcacatgcaaggagatggtagagagttggagttgttacggccctaccacttagtagcaaaatgtccttgggcaagttatataacctcctaacactgactttttctcatctattaagtagaggtaagaaaggtacctacccactggggttgttgacgataaagtgagaccatctatgtagagtgcttagaacaatgcctgggaataaaggttccataaatgataagtgatcatgagaatgtccttatgcagctgtagtctctgttccagagctttttctcactgatttttgttcttctctttgggtacatacaaaacaagggtatctccaaaccacctgaatgtccttcaaatatctgaagccattgatcaggtcattaagagtctgagcttctctaggctaaaagtaaccaatgcctccaatcattattgttcttagaaattcacctggagtcccttccctaacttggtcacctcccctgaacacattcttgtgcatcataagatgtgactccagactcaccaccatgcttgttctagaacagaggtctgcaaactacagcccttcgtgcaggctaatttttacagcccataagccaagaatggatctgacatttttaaaggattgtaaaaacaaaacaaaacaaacaaaaaacagaaaagaatgtatgacagagactatacgtggcttgcaaagcctaaaatacaactgaccctgaacaactcaggggttggggctctgacttttcatgcagtcaaaaattcatgtataacttttgactcccccaaaacttaactgctaatagcctattgctactggaagccttagtgataccataaacagtcaacacatattttgtacattatatgtattatatattgtatactgacaagtaagctagagcaaagaaaatattaagaaaaatcataagagaaaacatatttaatgtttattaagtggaagtgaatcatcataaaggtcttcatccttgtggtcttcacattgagtaggctgaggaggaggaagaagaggaagagttggtcttggtatctcaggggtggcagaggcataagaaaatctgcatatagtggacccgtacagttcaagctcatgttgttcaagggtcaagtgtattcactatctggtcctttcagcaaaagcttgccaactcctgttctggcagatactgttcttttatcaatgcaatagaatattgcccaaaactttttggcaatcaaattgcatgactgtacatactgtcttaactgtaaggctgcaaatgtttctgtcagtatctattcccctctccccttcttagtaataaaattcttagctaggaacatggctacccagccaaagactacatttcccagcctgtcttataggaaggtgtggccagaagaacaggttctagccaatgggatgtaaacagatgtgaaatgtataatttcccagccatactcttaaagggaaggatcatgcttcccttcctttttccttttgccattggctgaaatgtggacctgatagccatgtggatgagtggtgcagagcaacgagatagaaggatcctatccctggtgctgccatttcaccctatactgtttattctcaatctgtgagagggaaataattgtttagcttattgaagtcattgttctattaggtctttgtgacagcaactgtatctgtgccctaagccatacaactatcattttcaactccctcgtactttttatatttgcagctaccaagccacacacctcccctgacctgcactcacacagttaatttcctggaccccactacaagaccttacatttagccctattatgtttcatattattcgaatcagcccatcattttgccctgacatctgggatctaattctgtcactcaaactagcttctatcctttgtaatttcacatcattcttcaaaaggcactttatttgtggcactcaagctaaacacagtgctcatcaaaacacctgatcaatattaagtataatgcagtggggaggctatgacctcagtttgtaggggaaggaaatagcagatcaaaataaggtccaaatgaagtagaaggaggaaaggaaggagatgagcagttatggagagcttactatgttccagtcactgtgctgggaacttcccccatcgtgaagttttagtgccttaagtacccctattagtgccttaagtggaatagtcataaatttgtgaacaaagaaaggaatattaagagaaatttttaaagtatgttagctaaagtttcttgcagcctgaaggtcctacttgaggttgtgtatcaaaaaccctatggagttttagggaaaatatggatgcttccaagttgctacaggagggtcttggcatatgtatatctttaaggctccatggctaactctgacaaccctgataagccactgtgagtttcagctttctagcacactagaaagtttgaggcagagactctgctcagctaccagctcctggagtctgactcagctttctgtctcaggcgaggatgtagccttgtcaggctgtttgggttcaagaaccaggagagtctgatgttggtaagaattcccttctaggaagtattaagcaaagtgattggagtatttccctgagtcttgtaagcttctagtacaaaaggagtgtggtgtagcacaaatgagtttctctgatctggtgagatcctcctttgggtacccatttgacatctcccaattgggcacccttgggagccacccaatcctgcactgagacaggccacctggctcctggtcagtttgtgtactctggctaaacaaactctgtatgtgtgttttgggggtggggtggagttctcttgtggcaacccatagactacccaaaaatgctgcaagacaaacataccaaagtcatcaaaaagtcattaaagtcatgactagagaatagtgaataaacaccccaaatcacatgtaatttattacattcacctagggtaaaaaacttatgtgccttcagggccaatcaaataacgtaagtgtgcaaagtagcttggcataagcaaaagagaactggagtgttcatgcctctctacatatctaccttttaaaaatgaaaaagctgaaagctgtgtagctaaaaacaattggaatcagaagatggaccaccagtttgcaacccttctccccgataatcacagtccacaaaagcaaggagaaaaaaaacttcatacctctcttagaaggataaaagaattatcttttaaaaacggcttgtaggcagggcacagtggctcacgcctatagtcccagcactttgggaggcagaggtgggcagatcacgaagtcaggagttcaagactagcctggccaacatggtgaaaccccgtctctactaaagatacaaaaaattagccaggcgtggtgacgtgtgcctataatcccagctactcgggaggctgaggcaggagaatcgcttgaacccaggaggcggaggttgcagtcagccgagattgcagcattacactcctgcctgggtgacagggcgagactccatctcaaaaaaaaaaaaaaaaaaaaggcttgtaaaagcatgtattgctttttaaagcaatttttaagaaacagttaaataatatccctaaaaataggatgtctttaaatgagttgggtcagatgaccctattacagtaattctcaaattatagtccaaagactacagtgggttacaggagtgcccaggtggtatgcaaaatgttcttccacaagtctcactcacagtctaaagtgtcccttatagcacagaggattcttcatttatttctttcagggctacttcatcagatgctctccctactttttttctttttattttgaaataattttagacttatagaggaattgtaaagattgtacaagttcccatacaccctttacccagttttcactaacagaaacatcttacataaccatagtacaattattaaaactaggaaattgagattggtacaatagtattaattgacctacagaattttctctaatgttaccagtttttccactgatgtcctttttcattccaggattcaattcaggatcccacattgcatttagttgacatttctccttggtctcctctgttctgtgactattcctcagtctttccttgtctttcttgcccttgacccttttgaagagtacttggcaggtattttgtagacagtccctcaatttgggtttgtctgatgttttttcgtgattaaactgggattgtggagttttggcaagaatgccacagaaatgatgcacccttctcagtgcatcaaactggggaagggagacatgctgttaatatgtcttactggctgggtgaggtggctcacatctgtaatcccagaactttgggaggctgaggcaggaggattgcttgagcaacttagtgagacctcacattatcccttggttaaggtggtatctgccaggtttctccaatatgaaattactatttttccctttgcaattgataaatattgggagtctcaaatactttgagactatgcacacaccatgtttctcaaacttatacccattagtttaacagctatcaggtgaactgtctgcagcaactatgactgcagtgttctaggggtgattttctatttcctccacttctctctatttattcactggaattcttctggtaaggaaaaactgtcctttttccccatcaaataatcagtgtattcaacttttatttttatcaaaacagactcatggatagttattttattccttcagttataacccaatatatccttacttatttttttgacctaaattgttccagctttggccaataagagctttttcaggttggttcctgtactctgcatattcccattgttgttgttgttgttcagcactttcttactttctagcaccagaagatgctccaggctcatcttgtagtttgcctacccagtcctggagcctatgtttccaagaagtcctggctccttttattaaataatagcatttagagaccaagattggggaacctgatgtgctcactgctactgggatgtcagtgcttttagtgctacagtgctacaggccatctcagtagacagagctaggaaacatatgtatgtatatttatccatgaatacacacctatatttccgtatctatcagtgtatatgtgtgagtgtgtgtatatgtgtttttatatatatatatatatatatatatatgtttaaacatgagttaatactgatacctctgactctaatcaaacaccatggattcattccatcattctgctttgcttattagtaacttctttctcagacagacacctgcgtcttattatcaataatatatttgcttatctgttcattcctagtatatatgtaaaatagttttagaatggttaacacatacccctgtgaaggacaaatttatcatgtagagtacagtgtctgtgtacagttatttttgtctttagccttacagaattccaaagttacttaggtcagctcccttcttcctcatcatcttcaatgaatttatgttatacacgtgcaatgcagttagattcatttgtcatattctgcattacatcttaggttcctcagtatcctgattgattttgttcttaatttgcacacggcaaaatttacactttatggtgtacagatctatgggtttgacaaatacatagagttttgtgccatataaagcagttccatcagccacaaagttacctcatgttgctcccttgcagtcaactccaacccaaaccccaacccctggcaatgcattttccataaatgtagttttgtcttttctaaagtatcctatggaatagtaaaatatgaactttttgggtctggattctttcacttcgcaaaatggatttaagattcatccatgatgttgcatgaattaatacttgtgcctttttacagatgaatagtgttccattttatggatatatcacttctgttcgcctgttgaagaccatctcagttgtgtccagtttgggtgtttatgtgtagagttgttacaaatattcatgtatgggtttctaagtgaacacaaaatttcaataacttgagtaaataccaaggagtgggattgccgggtcatataataagtatatctttaattttataagaaactgccaaactacttcgcaaagtggttgtaccattgtgcattcttaacaagaacatgaaagagttccagaggctctgcatccttgccagcacacacttagtgttgtcaggtttgttttttcttaactgtagctattctaattgatatgcatgatagttcattgtggttttaactttgatttccctaattaaaaataatgttaagtgtctcttcatatgcttatttgccatcatatgctttctttggtaaaacatatgttcaaatattttgcccattttttatagagttgtttactttcttgctgaagcttgaaagttctttatatattctggatacaagtccttcattacatatatgattgcaaatattttctcacaatctgtggcttgtctttttattcccttaacattgtctttcacagagcaaaatttttatttcaagttcaattcattaatgtttcttttattgattgtgcttttaatgttgtatctaaaaactctttgccaaaccaaaggtcatattttctcctgtgattttttttctagatgtattgtagtttcatcttttacatttagatctatgatctttttctcagttgttttttaaggtgtgaggtaagtgttgaggttcattttctttcttgcatatagatatccaactgttccaacaccatttgttgaaaagactatcatttcttcacccttgtcaaaaatgaggtgattatatttgtgtgggtctacctctgggctctcaactctgttccactgattattgtatctatcattttgtcaacactacacttccttgattattataactttgtaacaagtctcaaaattgggtactgtctgagtcctccaactttgtgctttttcagatttgttttcatggggacaaactgacatcttccaatccatgaatacagtatctgtatttattttactgttctttaattgctttcaccaggattttctagattttagcatacctatcctgaatattgtttttgttagatttatatctaagaatttgtgggtttcggtgctactgaaaaggctattgctctctaaatttcaaagtccatatgttcattgctagcatgaagaaatacaattgactttgtatcttgcaaccttactaaactcacttattagtcctagaaactttttaatgatccttcgggtttttctacaaagacaataaagttacacgtgaaaagacattgtttcctttcttccttttaaatctttttgcctttttttttcttgccttattgtactataggactttccatatgaagtcagataggagtcataagagagaacatcttgcattgttttttatcttaaggggaaagtgtttagtttttcaccagtaagtgtgttgctagctatagccttttgtagatgccctttttgaggttaagaaaattgccttctattcatagtttgcagatagttttaatcatgaatagatgattaatttttaaagtgctttttgtaaatctattgaaataatcatcgtttttcttttccttggttctgtaaatatatttaattttaatttcattggttgatttttccagtgttgaactagccttgcatttttttgttttgtttttttgtttgtttgtttgtttttggaaggcttttaactataacttcaatttccctagaagatatgggattattgaagatataatatttcttcttgaatgaattttagtatgtctgtccttcgaggaattgattcatttcacctaagttgtcaaatttatgggcacagagttgtttgttgcactaccttattattcttttaatatctgtagggtcagcagtgatgtcccttctttcatttctgatattgataatttgtatcttcttttttcttggtcagtctgcctagaagttcactaattttgctgatctttcaaagaaccagcttttggtttgattgatatatccaaattgcttttttgtttcaaatgtattgatttttgctcttattatgttcttccttctgcttgcactagttttaatttgttcttctttatctagtttttttctttttagggtggatgcttaccttactgattgaagacctttcctcttttgtagtgtaagcatttaactctataaatttccatctatacactactttagcttcatttcccaaattgtgatatgttgtagttctttttcattcagttcaaaacgcttttttaattgccttaagacttcctctgacatatggtttatttagatatgtgttgtttcatctccatacatttgaagattttccacttatatttctattattgatttctggcttaattccattatagttcatgaccatgctttctatggtttctagtcttttaaggttgttaagtttgctttatggcccagaacatagtatcatttggagaatgtttcatgtgcactttagaaagaagtgttgtcatgtaaagtatactataaatatcaactgggtcaagttggttgataatgttgctccagtcatctatatttttgatgattttctttccatttgttctatcatttactgaaaaaggagcactgaagttttcaactgtaattgtgaaactatctatttcactttttgattctatcagcttttgcatcatgtattttgaaactctgttgttaggtacgtacatgtttagcattgttatgtcttcttggaaaatcaagccctttataattatttgatgttcctttttatcccagataataatcattgttctaaaagtctcacttgtctgatagtaatataaagacttcagctttattttgattagtgtttgcacagcatatctttttctattctattacttttaacctatctgtctttataactaaagtgggtttcttacagaaagtgtatagctggttcttaatttttcatacaatctgacaatctccatcttttaactggtatgtttagaccattcacatttaatgtgattatagatatggtcaaattaaaatctattttgctagctgtttttttgttccttctgtttttttcttcttttcttttatttttctgacttctctcgttagcctggtttgggggtgtgtggaggaaatggtttctattgttctgattaagctgtagtcttaggcaagcactatatcactgagtcctgaagcagcagccttcccagtgatcccatccctcccctgcttcacttctgaatccagaatgtatatccatcctttccctaggtgttaagatttttttccctgttcccttatctcagatgtaatgggatttcaccagtatccaaagagtgataatgtttgctcccttctacatacatgtcacactaattaaggcttttgttcataggggaggtaggcaagaagggtccaggtagaatttctcacccctctcacagcagtttcttttcctctcctccagcaattcactacaagggagattttctgtagactctcccaaccatttttgtgaacctgtgatggggttcatggagaaatgagtctaagaaagaaagtgtgatctccttttatttattatccctagggctttgcccgcttctactagagttcattaagccagattctgcatattcaacaaccaccttagctgaattcatataggtatgtttcttgcttaggtaagtcagagctcatatctcatttctccctgaagatacctatctcttcctcgattttgggcctactgggtacccagcaaccttaggactccagtgagctcaagaaaagttgtgaactttctattcgtaaagattttttttcaccataagtttaggaacaatccttcccagctgtctacatctttgagaagaaactagaagtctaccttcttataggtacttttgcatcttttgcaacagcaaacagaagaaggtacagcagttggtcagggtaatcactattctcttggaaacttgcttaaagagctttaggaatgacagatgttccaaaaacacctctatctgttgtttttgagaaatgtaagatatacggggaaaatcctataggagttaagtaaagtacaaataatgtaccaatttttcaaaaagtggagggcagaatctgtataaactatcagtcagttataattcaggacaactgtcttgttgaaagcatctaccagcctgcaattgcctggcaaagaatatgatgccacatagtaaacaccatggatggtgaagaataaaataactctagaggctttctagtccacttaatttcagaattgttcatacatgtcaccatttagtgagaaatatgacaggcaactaattactcaaaattaggctaatgacaaaaacattatacttatgttttattatttattctagtttccccaaaggtaagtcttgtcattaatcattaactactccatatattattattattaaaaatgataatgaaacaactacaatttagtgaccactcactactagccaaagactatgcttagctaatagcaaacatgttctcatttcaccttcacaacaactcagtgagagaagtgggactcagagggactaagaaactcgtcaaatccacagaattaacatatgttagaactagaattaattcccaggtcagattttaaagtccttacttttaacttctgagtcagactatcccagatgatgttaattatttcctgtggcccattgagtatttcctgctgtcatttacaatgctggaaaaggtccatccttgcataagaacacaaaagcatcagaaatgccttattagctgagtccagttgtccagccacaagggcattcagtttcagaatggcaacaagggactatttgttgagtgaacatgacaactgacctttctgagattggtttgcaaagagggcataactgtcctccatgttttttaaatgtctctctcactctctctctgtatacatatatatgtatgtaaatatgtgtgtttgtgtaaaatattcttttctttcctgtaatcctgtattatctagcaatttagtcttcttgaaattatatatatatttatattatatattatatatattttatatatataatatatataaaataaactacaactaactctaagaataaagagccctctataagatttctaccatctctaatgaggaaacataatgtgatattctaagatcatcttagatacctggagcatagcaacagcacagcaatgagtttcaaagacaacaatgtgaacagctaccactaaatcttcagttaggggagtcgagctatactcaagtatatttcacctaacctaaacaaacctgtgtaaaataagatagcagactacataggaaagacagtaacaagcaatggcaattgcctgcaagtaaaaaggaagagtgctacaaagaacaaggagaagtagtcaattcagggaaattcagttcaagggtaaatgtaaatcaccctctgtaaccccaagatggagggtcacctgccagaatctctgaactataatacaaagcagtaactaatgcttcccaacctattgcaagtcaagatgcacacagaaaatcaatctattcagatgactcatgtgcgagtcaagatgcacacagaaaatgaatctattcagatgactcagcaagaggcaactgatccaggggcttctgtcacccctcaagcccggcctggcttccctgagaggtggagatggagggatcatatttccacacacctgtaatccattcacaacacaccactgagcttttgtccaccaggtggaaagctctgcaataacttgtgtcaacaagaagtagttccattatgtttggtctactccacttaagaaggtgggaaaatataaaatatcacagagtaatatttccatcaaaagtagttaaatgttaaaacattttgatgcttagagggcaagcttcagttagaaaaattaactcttggaatgcctcatttcctgatgatgcacaaatacaaagtgtgactactctgtcttttattggggttcaaggtatatctatcaaatcattctgttatctcaaggtatttgtggagtctgaattaaccatatcagtacccatgatggttttaaagtattattatactggatgaccatatgctcttatgatgggacacactggaggtaaagggatttctattaataattacactataatcactggtataagccagggctgtcctaggaaaaccatttggtcaccccagtattagatcattctccctatttggtcctaacctttttacaacaaagaaagctatgtttatattcttcattaaaatcataaataaaaataaaacagtgcatgctagtagcaataaactaaaaactgaaatttataaaacagaaaataaaagtggtaccatttataatacctggaatcattctttccagagataacctccattaacagtcttctttccagtcctctttatgtggggagaactgatcccccaacattattatccaaagtcagacaaatggatactgggtggccaaaaataataaatatatattctatacacagagttcacatggagcctacccctctcctgcagtcctggggtacagcatgcaatttggttctaaactgctgggcacaacactttcttcctggtcatgatgttggttcaaggtggtcacaggactcttttagagccagtgagacacaaagaaacttttgctcagacttctaggaagacaatctaggtacttatcaaattgaaactgagaggatcgaaggccttgacctgcactatccaaaatggtagccactagccatatgtagctattgaacacttgaaatgtgaccagtacagaaatgtgatgtaagtacaaaaggcacactgcatctcaaagactcagaaggaaaaaggaatgtaaaatatctcaccaataatttttattttgattacatgttgaagtgatgatgcatatggctcatattttctctctagtggacaatgccagtctaaaacattgaaccattggtacagccaggcctgagggtatccctggtcatggacttttcagatatgtcaactaataatatctattttgcttaagaaagttctgattggacattctagcacttgcaactgagaatcctaactggtgcattgtatatgtagagtcatgccatacattcaagactgaacaaccaatcatgagcacttgttcatgccagcaccttaagagtagtgtgcccagatctgcacaaagtattctatatgtggacaaatcaaccattgtttttatctgttaacaccactgtatgtgtctggggtgtgtcaccagctttctttaaggtcttccagtgccaaagtcttcttctcctggcctttgcacatactttactttctgcatggaacacgctttcctctctttcacttgcctggttccctctcattactcaggacgcaatttaaatgccatctcctcagagctgagtttcctgaccactctattttgagtaggtcacccctgatattgtctctcatagcaccacatctcccctatatggcatggaccaaaatatgtattaacctctgtagaaggctgtttaacatctaccttctccttccccaccataccataccgtgcatcaatgcagaagccatgtatatgtggttcacccatttgtccccagcacctggaacagtaactaacacatagtaaatgctcaatcaacatctactgaatgccaggaatgagtgttaatgagtccaggagaaggaggaaggtcaggggaagatgaagtaatgggggaagggaactaagataattcagtgtaaccaaaccactgatgaatgttgattaatgccatctagaacactcaaaaagaaagtaaggatgagaactgacagaggaagagcaagtccagaatggaaggatttgagcagttagtggctgcctggaccttcctccaggcataaaagcaaatggtcagagatacaaatgatgaagcctgcagttcaaatgcatttctgaactccacacaatgaaaattatgctgagattttgctttctgttagtgacaatctggttcttagtctcattctcataacctaaatacaaaactatgggggaatctgagtcctactctaggaattttcatcagactctgctcaaaggcaagatcacattctttgacttctgcattgtggagcttctcatgaggctgattgaaatgctgctgttcatatcaaagccagcctttctggacttcatcgaatatctagatcccttctattttcctcttcacattcttgttctcacacatgatctttgccactaccctgcttgcttacctcagcttaccttatacctcggaggcagcagtaacggtttttactaaaaccctttaggattgatagatgatagcctctaattatttctctggagataaggcctctctttaaatgagaatggctcttctttttgttttattgtgatatatatttttaattcatttattttataatggaaagttgatcaatacaaaataattcataaaccaagcacccaatttaagatctagcattttattttggaagccctctgtgtgtccctctttggtttcatttcattttttaaagaatgaaaaccactttgttagtgaactccagaatttgggaataaaggggttagaaccttagaatttaaagatgtggtgctgtccaccaggcaggtgctgacgagtctccggaaaggtgggagagccaccgcagtctctcagaggaaagaagaaagtgcttagtcctttttctttttatttttccttctcccactttgatctctcttctttcttcctttttaagaattactacacctcttctctttgctggtaagacgagggaagtcaacagagctccacgattctgtctccttctttttctaacagatggtttccattagggcttaccaggtattttctctgaacagaatcaaacatgcattgaaaaagtaaacatcaggatcatagaactagcagccctttatttattacataaatacaaagattttatagctggaaaagaacttagagataactaaatccaatcttcttgtttcagacctaagaaaaccaagactcagtacttgcctgagttattaaggttattaagctaaatatatgtcttccctctccaaatcattgtttttatttcccatttttctttttttctttttctttattttttatttcccatttttcaattctcattattaatatattttcattattgataatttgatcacattattgattattttactttagtctgaggcacctagccttaggctattagtattttcatttagcaatattaattacaaaatgatttttgaatgatacctaaaagatacctcacattaatgtaaaatactttgttttattcttaacagcatttatctcagaagtcactaaatattcaatcatatttttctgataccctgacattctctgcctcatatttctacttctaatgaaatatacaattgagctgaattttaaaaaatataggtacttcagaatattcctaaatgatgagtgagtcattaagttatttgtcatatcagaaatctacagattgctaacattcaattagttaaccaaaaaccccaaatgcccactaggtgcccaacactgtgccaggcatttttcttatgcaccctctttaaagtgaaaatgtttgaatttcagattttcaagaatatttgcatgtatatatgtatttgcttatttattttatgcaataaattttatttctgttattctcaaggcactgtgctaggcactgttggaggtgaaatgaactcttaagagaacatactatcaagaaagagacaaaaatgtttacataaatatctacaatatgtggcttaggagagtgatcccaaacacaaatgaccacagaggccaggtagtcaatgtaaatgcaagaaacacgttgtgtatacggcaacagggaatgggaaagttatggggagctataaaatgaatgttgcctctaaagaaaaaaattgagaatgaaaggagagaagatttgagaaggtgggggaagtgagagggcacaagtataacaggagagcatgaagagagaggataaagagagaagctggtaaagacagaggagagagagggggaggacaggcggaaagggaaggagggagggagcgggggagagagagagacagagagaaagagagaaaacatcaacactaaaaggtcaggtagaagaggaaaaccagcagagtatggtgtcccaaaaaccacaagagggaacttttcaaaatggtcaaatgtgtcaaattttgctgaaagtatctattggatttgacatcactgaggtcactgacaaccttgacaagaacagtttccatggtgtggtgagttagaggccaggctgaaacatgctgaaaagtggatggaaggcagacagcaggaaggcaaccctttcaagaagttttactgtgaagggaagcaaaggaatggggcagtgggtagagtagggcaagcagtcaaggaagaggtggtttttaaaaagacagttgatgtcgtcaggtttgtctactaatgggaatgatccagaaaagcgggagccattgatggcactggaagacgatggccaaggagccgatcctagagaaagggaatagaatccaggcacacataggaagagtggtctatgatctaaggagggacagacacttcttccatcacactacagagaagaaggaaagggggtgtaaatgcctgcatggtgataaatttggtggtggaagtatgagggaattcccatctgatggcttcaattttctacataaaatagggaaggacatggcttgagaataagcagggagggtaagtgaaatttgcagaaggggaaaaagtgtgaagtaataaccttgggattgtgaaagcaggcccactagagaaacacagtagaaaatacagagcacccggttatgatctggaattataaatttaaggcacaaccagacaactttttattttgtccagcaaagtccagctgatcaaaagggcatgaagaagccatgaattgcccacacatcttgagaaaacaccgtttctaagccatagatcagggctggggcctgaacttctgcacttctaacaagctcacaggtatctccctgctactggatcgctggatcacactttcagtggcaagtgtaatccgccaatttcctttgtcattcttttctcaagtatttcagtaggggacacaggagatctgtcacctctaagtctgaaaaaataatattaataataaaaattaaaacctcaaaaataatagaaaaagggaggaaggacatggagaaagaagatgatttggtttatccaactgtggctgtattagaaatatattttcttgcccttcttcttatctacatttccagctttggcagtctcatgcagtctcacaacttcaaccaccatctttatgtggatgtacgatgtctttcttagatccaaaggcacaattaacacatccatatgggtgtcccatgagcaactcaaatgataacttgtcacctatatttgctctccttgatcttttcatccttttactcttctcattctcactggcctccacatttaaagttgttaaggcctactgatttatccctaaaatatcagtagtttctatggatgcaaattagaactacactaacacatcatttccccttgtcagatatgcaagaatccaaaagtttgatgacataccctactggcatgactgtgaagagtcagagacttgcatgcattgttagcaagaatgcagagtggtataacccctatggaacttttttgcaatgtatggccaaattacctaagccttgatcctttaagttaggaatctatcccaaagacacactagcaatatgtaaaatgatacatgcacaaagctatttgtcaaaacacaatttgtaatagtaaataaatgaaaacaacccccaaatgttcatgaattagggactagttgcattcataaaactgagaattatatgaataattctcagacacagaaaggagtgaggaaaatctctatatattgctatgaaggaatgtaagtgaaaatacaaaattcagaagaatgaacataatatgctactttttaatataaacaggaagatatatacatatttgtttatattttcttttttttttctttttttgagacggagtttcgctctgtcgcccaggctggagtgcagtggcatgaacttggctcactgcaagctcggcctcccgggttcacaccattctcctgcctcagcctcccaagtagctgggactacaggcgcccgccatcacgcccagctaattttttattttttttattttttagtagagacgggtttcaccatgttagccaggatggtcttgatctcctgacctcgtgatccacctgcctcggcctcccaaagtgctgggattacaggcatgagccaccacgcccagccacatatttgcttatattctcaaaaagaagaaatggaaagataaaccaaaaattaataaaatgggttacctataggagaaaggaaagaacaatgggaagaggatttaggtggaagctggatctctttgaatgtatcatattttatagttttaagttcaaaatcatgtaaatgttttgcataattttaaaaaattaaatagaaaagaaacaaagtaatctataaaaatcaaaacaatctgaaatactcagtggcttcccactacctaccttgactccaaattcctgagcctgaattcaatgatctctttagtctgcccagccaaatattcccacttcactttctgaggcccccttctccatcttctctacacacagacaaactattaacattatctgtgtgcctaatttattttgccagctagaccatacttctttgagaatggaatctagttctgatttatttttgaaacctaaaattctcagtgtctagagttattaccagaacataaattagtacggttatggcatctgaaagttattggcaggaaattttatgtttattctgaagaattcaaggaagccatagctttttgataatatgtaaaatatctggctaaagagtaactttctagttacaaaacagaaaaaataattgaagcaatctgatatccatcagcagatgaatggataaataaaatgtggtatatccatacaatggaatattattcagccttaaaaaggaaggaaattctgacacatgctactacacagatgaaccttaaagacagtgtgctgagttaaataagtcagtcacaaaataacaaatactgaatgattccacttatatgaggtacttagagtaataaaattcatagagacagaaagtggaatgatggttgccagggactgggcaggaggtgagaggaagtaggagttattgtttgataagtccagttttaattttgtaagatataaaatgttctggagaaggatagtaccaggttgcacaatatgaaggtgttaaatgccgctgaactgtatgcttaacaatggttaaaatggtaaattttgttatgtgtattttgtcacaattaaaaacaattttaacaaggaaaacaagacatttgggaatatcttttaatattggctccttttattaatgtaacaaagttttaaccaaggctatcctctccagagccattaaggatcacctagggaagagacggctttttgcttagaacatggtaccatgttacctacactctctctgaaacgaatttgcataagaactgttgtttatgggaatgcatcttgacggggcagctgggttgctatgaaatactcaggaacccagcccagctctaggactcacccctgagcacaaacgcaatgttggacacactggtaaaggaccactggaatccagcagcccggatccctttctttgtggtcaagaaaggcaggaaaagggatgcaggactgctacatcagtgagcatcactaatccgataagcagaggtccatgggtggtgatgcaccctggaaaggaaaaagcattaggaccatagaggacgctctaggactaatgctcatcggaaaatgactaggggtgctggcatccctgtgttcttttttcagatgggaaacattccccccaaggcaaaaacaccctgaagatatattctggagaactggggccaatttgaccctcagacgctaagaaagaaacgatttatattcctctgcagtactgcctggccacaatatcctcttcaagggggagaaacctgacctcctgagagaagtataaattataaccccatcttacagctagacctcttttgtagaaaagaaggtaaatggagtgaagtgctatatgtacaaactttcttttcattaagagacaactcacaattatgtaaaaagtgtgatttatgccctacaggaagccttcagagtctacctccctacctcagcatccccctgactccttccccaactaataaggaccccgccttcaacccaaacggtacaaaaggagatagacaaaggggtaaacaatgaaccaaagagtgccaatagtctccaattatgccccctccaagctgtgggaggaggagaatttggcccagcagagtgcatgtacctttttctctctcagacttaaagcaaattaaaatagacctaggtaaattctcagataaccctgatggctatattgatgttttacaagggttaggacaatcctttgatctgacatggagagatataatgttactgctaaatcagacactaacctcaaatgagagaagtgccgccataactgcaggccgagagtttggtgatctctggtatctcagtcaggtcaatgataggatgacaacagaggaaagagaacgattcccctcaggccagcgggcagttcccagtgtagaccctcactgggacacagaatcagaacatggagattggtgccgcagacatttgctaacttgcatgctagaaggactaaagaaaactaggaagaagcccatgaattattcaatgatgtccactataatacatggaaaggaagaaaatcctaccgcctttctggagagactaagggaggcattgaggaagcatagctctctgtcacctgactctactgaaggccaactaatcttaaaggataagtttatcactcagtcagctgcagacattagaaaaaaacttcaaaagtctgccttaggcccagagcaaaacttagaaaccctactgaacttggcaacctcagatttttacaatagaggtcaggagaagcaggcggaacgggacaaacgggattaaaaaaaggccaccgctttagtcatggccctcaggcaagtggactttggaggctctggaaacgggaaaagctgggcaaattgaatgcctaatagggcttgcttccagtgcagtctacaaggacgctttagaaaagattgtccaagtagaaataagccgcccctcgtccatgccccttatgtcaagggaatcactggaaggcctactgccccaggggacgaaggtcctctgagtcagaagccactaacctgatgatccagcagcaggactgagggtgcccggggcaagtgccagcccatgccatcaccctcagagccccgggtatgtttgaccattgagagccaggaagttaactgtctcctggacactggcgcagccttctcagtcttactttcctgtcccagacaattgtcctccagatctgtcactatccgagggggtcctaggacagccagtcactacatacttctctcagccactaagttgtgactggggaactttactcttttcacatgcttttctaattatgcctgaaagccccactcgcttgttagggagagacattctagcaaaagcaggggccattatacacctgaacataggaaaaggaacacccatttgctgtcccctgcttgaggaaggaattaatcctgaagtctgggcaatagaaggacaatatggacaagcaaagaatgcccgtcctgttcaagttaaactaaaggattctgcctcctttccctaccaaaggaagtaccctcttagacccgaggccctacaaggactcaaaagattgttaaggacctaaaagcccaaggcctagtaaaaccatgcagtagcccctgcaatactccaattttaggagtacagaaacccaacggacagtggaggctagtacaagatctcaggattatcaatgaggccgttgttcctctatacccagctgtacctaacccttatactgtgctttcccaaataccagaggaaacagagtggtttacagtcctggactttaaagatgcctttttctgcatccctgtacttcttgtttgcctttgaagatccttcaaacccaacatctcaactcacctggattgttttaccccaagggttcagggatagaccccatctatttggccaggaattagcccaagacttgagccagttctcatacctggacactcttgtccttcggtatgtggatgatttacttttagccacccgttcagaaaccttgtgccatcaagccacccaagcgctctttaatttcctcgccacctgtggctacaaggtttccaaaccaaaggctcagctctgctcacaacaggttaaatacttcgggctaaaattatccaaagacaccagggccctcagtgaggactgtatccagcccatactggcttatcctcatcccaaaaccctaaagcaactaagagcattccttggcataacaggcttctgccgaatatggattcccaggtatggcaaaatagccaggccattacatacactaattaaggaaactcagaaagccaatacccatttagtaagatgaacacttgaagcagaagtggctttctaggtcctaaagaaggccctaacccaagccccagtgttaagcttgctaatggggcaagacttttctttatatgtcacaggaaaaacagaaatagctctaggagtccttacacaggtccgagggacgagcttgcaacccatggcatacctgagtaaggaaactgatgtagtggcaaagggttggcctcattgtttatgggtagtgatggcagtagcagtcttagtatctgaagcagttaaaataatacagggaagagatcttactgtgtggacatctcatgatgtgaatggcatactcactgctaaagaagacttgtggctgtcagacaactgtttgcttaaatatcaggctctattacttgaaaggccagtgccgcgactgcgcacttgtgcaactcttaacccagccacatttcttccagacaatgaagaaaggaaagaacataactgtccacaagtaattgctcaaacctatgctgattgaggggactttttagaggtctccttgactgatcccaacctcaacttgtatactgatggaagttccttcgtagaaaaaggacttcgaaaagcagggtatgcagtggtcagtgataatggaatacttgaaagtaatctcctcactccaggaactagtgctcagctggcagaactaatagccctcactcgggcactagaattaggagaaggaaaaagggtaaatatatatacagactgtaagtatgctcacctagtcctccatgcccacgcagcaatatggagagaaagggaattcctaccttccgagggaacacctatcaaacatcaggaagccattaggagattattgtcagctgtacagaaacctaaagaggtggcagtcttacactgccagagtcatcagaaagaaaaggaaagggaaatagaaaggaactgccaagcggatattgaagccaaagagccgcaaggcaggaccctccattagaaatgcttatagaaggacccctagtatggggtaatcccctccaggaaaccaagtcccagtactcagaagaagaaatggaatggagaacctcacgaggacatagtttcctcccctcagaatggctaaccaccaaagaaggaaaaatacttttgccagcagctaaccagtggaaattacttaaaacccttcaccaaacctttcccttaggcattgatagcacccatcagatggccaaatcattatttactggaccaggccttttcaaaactatcaagcagatagtcagggcctgtaaagtgtgccaaaaaaccccctgcacttcaggccatacatttcaatccctgtacctgaacaatggaacaacttcagcccagaaataaacaccacttctgttttagtaggacctcttgtttccaatctggaaataacccatacctcaaacctcacctgtgtaaaatttagcaatactatagacacaaccaactcctaatgcatcaggtgggtaactcctcccacacaaatagtctgtctacccacaggaatattttttgtctgtgacctcagcctatcgttgtttgaatggctcttcagaatctatgtgcttcctctcattcttagtgccccctatgaccatctacactgagcaagatttatacaattatgttgtacctaagccccgaaacaaaagagtacccattcttccttttgttatcggagcaggagtgctaggcggactaggtactcgcattggcggtatcacaacccctactcagttctacaaactatttcaagaactaaatggtgacatggaatgggtcactgacttcctggtcaccttgcaagaccaacttaactccctagcaacagtagtccttcaaaatcgaagagctttagactttaggctaatcgccaaaagagggggaacctgtttatttttaggggaagaatgctgttattatgttaatcaatccagaatcgtcaccgagaaagttaaagaaattcgagattgcatacaacatagagcagaggagcttcaaaacactggaccctggggcctcctcagccaatggatgccctggattctccccttcttaggacctctagcagctataatattgttactcctctttggaccctgtatctttaacctccttgttaagcttgtctcttccagaatcgaagctgtgaagctacaaatcattcttcaaatggagccccagaggcagtccataactaaaatctaccgtggatccctggaccagcctgctagcccatgctctgatgttgatgacattgaaggcacccctcctgaggaaatctcaactgcatgacccctactatgccccagttcagcaggaagcagttagagcggtcatcggccaacctctcaacagggttttcctgttgagagagggtactgagagacaggactacctggatttcctaggctgactaagaatccctaagcctagctaggaaggtgaccgcatccacctttaaacacggggcttgcaacttagctcacacccgaccaatcaggtagtaaagagagctcactaaaatgctaattaggcaaaaacaggaggtaaagaaagctagtcatctatcgtctgagagcataatggaagggacaatgatcaggatataaacccaggcattccagccggcaatggctaccctctttgggtcccctccctttgtatgggagttctgttttcattctattaaatcttgcaactgcaaaacaaaacaaaacaaaacaaacaaaaaaaaacgtggtaccatgctctcctcccccaccagccccaagagtatttccaacagaaactttcttccctgggaacactttgcaccttgggctttgtataaccaggagtaacacattggtgattaacttaagaggtgttttaagattctgatgcttgtttctaatcaaagctttgtattggcatggatccataataattgcatttgtgcttctgagtagaatgctctatcccatccatgccttcccctctattctcacaggaaaaatgactatgctgtgagctactgccacctgggaagcatttacttctgactttgttttaaaactttgtattttgtactccattaatataacatgtaaataataggggacactatgtgaagagggcaaagagatatgtgggaactctctctgtactttcagatcaatattttgtaaacctcatactgccctaaaaacttaaagactattgatttaaaaaataaaactttgcatctgaaattctttgagttgctgttacagaaaatggtcttattggtccatataagtaaaaatgatactttgttaacagggagatatgttcttgtttaaacatgtaatatatctggccagaaactgaaggcatattgagctagtcagtcaccattctaaccacatttgaactttaaggaagaaaactaattagaatgcaatcccctagtttctgctcctgactgtgctggaaatccccacgtttctaacacatagctttgcttctgtattgccacttagagagtatggtgagacacattaaagtctttgaccataaaagcaattaaatactgaaagaagaagggggcatttgaaatgcccttctaagaattatttaaaacatggaaaacaagcttacacttctagctatgatggagttgcatctatccaactcatggtgatagagttcataacataatgtttaggggaaaaggccaaaaagatagcacactgtatgatcccatttatataaagattaaaacgagacaaaattagagtatggcaatataagcctaaatagtgtttatgtttgatgggtggcagacaatgactgagagagggcacaaataagatttctggtgtgctgaaattgggagtgatctcttcttgtctgggtggagatgagagaacagtgttcattttatgtaaattctacaaactgtaaacttactatatgtgcacttggtgtgtgtattagtctgttctcatgctgctatgaagaaatgtctgagactgggtaatttatcaagaaaagagtttcaattgactcgcagttccacgtggctggggaggcctcaggaaacgtacaatcatggtggaaggcacctcttcacagagcagcaggggacagaatgagtgccagtaggggaaataccagatgcttataaaaccatcagatctcatgagaactcactcactaccatgagaaaagcatgggggaaactgcccccatgattcaattacctcccacttggtccctcccacaacatgtggggattgtggggagtacaattcaagatgagatttgggtggggacacagccaaaccatatcagtgtgcatacaatatatttaaatagtaagtaaccaaaacatgtagttagaaataaattacgtgaacaactagacattccctgacaatggaggtggcagaaactggactggaagattctgaaggcagctttcaactgcatttcacttgcccttccataaagcagcagctctccttcagggctatcttccctgaagatacattctctctagctcatctgtcttctatatccaatttggattttgcaacagagagttaaatttattttatcaatttaacccctaagtcaacatattcaaaatcaaaatcttcatcatctcttgcttctcacttcatgaatttcctcccattctctatcacagataagagggtgatcaacttcctcaatgtttaatgtagaaatctcatcctcgctgcaccattatgtgattcctagttgtctctccaaaatcttcctcaaatttatgccctcttctccaaccacattgctttcattttcttttgttcattcattcattcattcattcattcattgtgaagtgtgtagtgcctgcgaggcccttcaagtggggttaaggatcagcagaagcaagttacttctggtccctgataaccaaagcccttgactttcaccaaagccttgacattcccagttgctttctatgtagtctcatgaaagttcccttcccacttctctcctccctctccactgccaccaattcacaactctcttttccagcacatataccctttacatgtgtatatgcacatgcatgtaaaggacatgcacattatttaaataagcaagacaagttcattaaagataatttggaaaatatataaagtaacaaaagggaaaaaatcctattattcatattactgacacccaaagatcgtgtgatataaaatatcatttatttttaaatgatgatcatcttttttagtatacaagtcaaatcattcccctcttttcttagaaggtgtcaagtcattccactgcctataggacaaaagtccttctcatgagcaatcgactcaaagccctttgcagtctaggcacagctgtccagctgtttttctggtgtcttctctagtcccctgcctgtccccaactttgacacatgggtccgtgacactgctcctggttatgggctgtggatactggatcttctgtgttcctgtctctgctcacattgttccctaggcctgcaatgatctttcctgacttcctcagccttgaaaactcctattcacttttcaagactaggttcaaatttcacttctgctggatcccacttgtgtgacacttgtcactgtgtgctgtgattatgagggaggcagcggcagagctgttaataatactgactctggagtcagactgcctgggttcaagtcagatctgtggcctgctagctgtgtgaccttgggccaattacttaatctgtctttgcctcagcctcatgtataagaggataaaatgctaaaactcttctcagagtgtttctatgaggattaaatgagatgatctggttaaagggtaacttagcacaatgccaggtacataatgagtcctcagaacatgttacttcttgtaattgtcagatgtctgcctcttccctcctagactgtgcacatcccataagaaagatttcttacttgaatttgtagccccaccccatgctcagtttggagtaagtgctttataaatgtctgagaaatgaatgaatgagtacatgaatgaatgagtgaatgatctgccaaatcttcccgacatactctcttgctctacatacttttattgttaaaagaaaccaaggaggaaaattgggataatgagaggaagaaggaaggagatgcaagagagggagaaggagaagaagaggacaaagaagaggaataccaatgaattgccactaataataatggtatttgacttttgtttgcacaaaaaaacaggcatcaatcacagtacccaaggctgcagcagcccttttttctgctaactcttcagaacccagaacatattggcccttacacttagtgcaaagctcagtattccattctggcctttggggaaactgagttgtgtaactggttctctacccagagagaagaccctcagatggcagaccacccgaggtgacacatctaaaaggactgcgcagggcccacccgcaaggttccaggacatggaatagaagagtgtgcaccaggcatcctatgcagggcatcagctcatcctcaaattccccaggacagatgcagcgctggatgtgtggaatatttaaaggttcccttgcagctgaagtaccttggcaaaacctgtttttactgactccagatatactggcttctacttctgttccagagtcagtgataaacccccaagaactcattagtactttctagcatgcataaaaggacagtaagcctttgttttgctgattagggaggccacatacatttttaaaaacggattattaagaaataaatgccaacctttgcagaaaaaaacacatttctctctgtctctcattgaaaaccaaggaggccttcagagacttcaccttggcacaggccaggtggtttcaccccaccctgcggggtctggctccaacctggcagctgtttgcaaggacaggccagtcgtcatcaaggccctatgtctctgagcagggggtcatggccattgtgagtcaaaacccacacagagaacactggcctttctgatgctggctgcaccactgccttgcagctttctgcagagccattaaaccatgaacttggaagtcagtcaggccagggtctgaactccagctcctctgcctacaggctgtggcccagggcaggttgcttcatcgctcttagtccgagtctcctcatttgtgaaataggggtaataatagtatctatctatctctcagcgttgtggtcaggattaaagataatgcacagaaatggttccacaagcttgggacgtgagtcacactcggtaaatgatatccattgttattattctttaggaaccattttctcagcttccaggttttttttttttttctctagtgtttccactgagaagatcaaaattgaggctggggaggctgaattgaaaattataacatctaattgttaggagcattttcaatgttccatgcactctgttggtagtatttacatgttttatctcagttaatcttcacaacaacatatcagccaggtactacaatgaaacccattttacaacagggagatccaagggtgaaagaaataaagtaacttatcttgggaaagaggtaaggaaggaaagaaattgcttggtagactgggtaggggtggggtgggagccgttttagaaaaattgtgatggaaaaaagaaagggaatattaagaagtgtctctgtgggttatgaattggttccctcctatgttctttcagaggcacaagtgaagactggaattctttttaattagtagctccatcattgttatgagaccacctaagtttagagggcatagttaaataggaggaaagtactttcaccagaattgcaaactgtgtcctacaacagcacacaaaaaaaaacccctcatattaaaaccaaccacaacaatgacctcaccgtattaagtcctgtgatgcatcctgccatgcagggcacatcctgaaaggggagaagaggcaactaaggcctccagctactcagctacacttaaccacagtaatccacccctaagtttctcctggggcacagttcctttttgttctctcatttttgtcctttctttaataatgaacgtgtgactcagaggtttaatgagttacccggagaagttaaccagaagggaagcccattgagcagaggcataattaaaattgtgaatggacagaggaatacaatcattgtgggagacagggagcacaggaatgactcacgggttaggttgcttagaaaagggcctccgggacttaagttatttctggggaagatctggaaattgaaggaaaaatctggaactcttctacagtcaaaagatagagaggcgagctgggacctctcctttcactcctgaatgatttaggcttgtagccgggactcacttccagcggaaggtgaagaacagtgaaggctgaattccccagggagtcattacctcctctggtgctaacaccacaagtgtctaatgtcaactacttcttggtttggacgtttcttatagcaaattataacagtcaggagaagggaaaaagcaacgacagcatcatactggattttcactctttagcccaaactcagaaatattttgcatctgttgaggcctgacaggcagagaaactaaggaacataagcacacactggagatggggctgttgtagttaacagaaagtctgcatgcaaacttgaggcccattatctgtttcgtgtatgaaacggtccagggtgctgtgagttcttaggagaaatggaggctgatcctaagcaagaaaaacaatactccctaggtcaggatctctgtagagcaccagccacagaaagcactttccacctaggaatctattccaagaatttctgtaactaaagccagttcagatcagccatgctaatggagcagcagtacaacttcatcccaaatatcacatggtctaagtattaggatttattgtcttatttccatgcttgtgttgatgcttgaagagggccaagattaccctctctttcctcctggaatacagaggcaatcacttcagcaatgtggagaagcagcgatgaaaataaaaagagacaggagcccaagttaggtatgaagtttgaaatccatttttaattttgtttgaatataagcttatatggtttttgaacagcgctgggagcaaattattgaagctacaatatgaaccatggaggagaaggagttggaaggtgctctcactttcagatcttgctcatttaaataaatcctccaaactcctttgtctatgctcagagtggacaagaagtgaattgcttgggtggtctaaaagaccttaggatgggtgagaaggagcctaaaattttcttttagtcaaaactatatgtttattttgtaaatatatgtatgcatatatttggaagtgaaattaatatatgaaatgaattatattagcatgaaagggctcagtgatttatttttcatccttactcaatagcaccaaggcagtaatttatatttttactatactttcttaaagtctacctcccactaatctgtaagccactataaacaaaagttaaaagaactgtccagagtcccaaaaaaactaaaagttttgccagaataatctttatacaaataaaacttcattttatcaaataaagtagaataaaatccaaaactgttactatactcatcctgatacaattcccccaaagtcataattctctaagacactgctaaacaagtaggggttagtttctcatcaatagctgtcagtaaatagaaaactattgagcacagccctagtctaacacagtggagctgaaccacttggggttaagtcctggcttccacataaatagcttaggcaagaaaattaacctttctgagccaatcatgccctttatgctctataaaagcatctgggagaacatcatcatgcaaggacaaactgggcagaagaaagaacgaggaaagttcaacgtgcagtgatccctactgtctagattggacatggaaagaaagctcagaactctagtggaggaggatgatttcagaagggcttgttcatggtccagatctattcttagctaaaggataagatgaatacctaaaaggttataatgcaatccaaaaatccttctagatttagccaactctcagtctgaatcactccctgagtcagggtaggacatggcaccagctcccgtccttgaacaatgcagttacctgagtcagaggctattttgaaaagctaaaactgatctacatctggcatttcaagggcaagccaattcacccacatgcaatcaaccacaggtgagttttccttctattcatagatatcctggaaataggcctgaaagtgtagaagaggcaatgtggagaagcagagtttggcatatatggactcccaaaccactatgaactagctctgagactttgaaaagttattcaatctctctaaacacaaaacgtctcatctataaaatgggtagcagaaaagactgcccattttgagtggcacccagggcaagaaagagctgcggcagctcccggctgcaatacaagcagccttgccatttgggccacgtgaccaggcacatctcaaggcactaatggcagctgtggtgaatgaaggtgctgtgtggtgccttgggcatgctccagtagtgcagaccctgagggttcaggagcgagacaatgccattgtaagtaaaggattatacaccattctgaaaacagctcctggtagttattgaaacttggtgaaaactgaacatctgaacatgaaacagcaagtgaccatatgggcagagctgtaaatcttgaactaagtacagtcagatccagcaagtcataaggtcaagaaggcccagcaacaatcctcataaagtagaagaggtacaccccaggtttcacatgagcagggccgggggtcacaagctgcaggggcagatgaccaggcccacccccactatgtcactcaccactgttgcagcaacccttcttccctcctagatcacaactatggcccattcctggatgacagaaaaggaaaaatcccaaggcttggcttggctcacagataggtcagcttgcctcccaatgggcaaagcttcaggaagcaggactgttcacccactttgcatgaagagaaaagtggcccgtggtaaagacagatgtatacagactcatggacagtcgtgcaaggcttggatggtgggtcaggggcttgggtaaaactagattagaagactgaggaaatggaagtctgtccaagggcatgtggctggacctgtgggagtgggcaccaagtgacatgagctctgtgttgtgtgttaaggccaaccagtgagcactgatgatggaagaggtgcttaactaccactggacaggagacttcagccggcctctgtccttggctatccagggcttatgcaatggctcatgaatggagcagccatgatgacagagatagacgctacccacaggcccaacagcaggagctcctgaattctgaagatgatctagctcctgatgctgctaaacattcaaaccgctagccacaaaagccaattctgagaccctgagatggcaccatccttagaggagaccaactggcttgatggtgacaagttgatttactcccaccctgaaaaggacaatattttatcgtgattagaattggcaaatattccaggtatagatttatttttcttgcctgcaggtctcagccaccactactatccaaggactccaactgactgctatagctgagagtctgatcctgcataaattcacttcagacaaagaaatccaccttacagcaaagaaagtgcacaggaacacatgaccatgtgatccactgctcctgctacttaccacaccatccagatgctgctggcctgatcgagcattggaacaacctcttaaaagcatagttaaggggcaagcttggacataacaccctgtacaggtgaggcactgcccttcgggaagtagcatatactttaaaccaaagccataatatggggctggttcccaagaaacagaatgcataggtctgggaactaaggctgggggacaaagcaggagtgaccccactctttattactcccagtgtcccttgtggaatttgcacttcctacatgtagtaccttatgctccacggggctagagatgtgtccaccaaggaacacagtttttgctaaaattaagttatagctgctacctccaggttgctttaggctcttcattctaagagtaggcaaaaaaactgagttgtcttactggcaagggggtatgaccatgatcaatatgaggaagtagagagactgctacctaatgggagcaggaaggaataggtatgatgtgatacatatgacgggtgacccactagggtatctcctggtacttcaataaccagttttaactcataaactggcaagtacaacaacaacagcctgataagggaatggaaaccaggggctcagaccccctcaggatgaaagttgggccagaaagtccaccacactagccacattggttagccagaagtgctagccaagaaagaagaatctagaaagggtagcagacaaggaagatgatgagtattagtatggcctcaggaccaactgcaaccatggagacggtagtttgtcccaataacccaaaaattctgaccaagaagaatcctgcagaagttatcagaagatagagtaagcttacaatgagaaacaagtggttcttaatggtacaagcagtagctggtagcagaggcaacagttgccttaactagagacatctgagaagtatatgctccccactcctcccccaagtgtcacttgtgacagactgatacaggggaataagagttcaactcccttgcctcaagacaggacaacctgtatggcacatctcacactctagagctcctcgaaggattacactgaagccagacttcttctaaaaccacattttttcctagtttcttctctgtcctatactgctttctccctctgttggaggtttttcctaagagcaatcccttaataaacatcttgcacaagcttcccatctaggccctgtttctaggtgcccaagcaggatccacttttgcacgcccacagtgtttacagccccatacgaagtgctaaaggcatatgagagtttgaggtaatgtttagccaatatccactctcctccccctccactgtgggcagaaaatacttccctgccccactgtggcagattgttctttccaaaaatggctgcaacactatctctcatccctcatgtacttttcacaatgtgaccttcatatccatcccatggagagttgggatccatgtctcttccccatgaaagtgagcaggtttttgtgactgtttcaaccaacagagattagtagaaatgatgccatgtgaatttccaaggctggtcataaaagacaaggtaccttccacttggtcctctgcaacaattgtgccaagttctaacattccttgtaagtggcctgatagtcctaaagccaccaagctgtgtggaagctcaaatgagttcatgcggggtccacatgaaaaagctgagagatacctgggcagctccctgcaatgccagctccaaccatcatcagactgtaactgcatgagagactctgagccagaccactcagctaagccccacctgaatccctgacccacatcaatcaagagacacaataaaatgattgctattattttgagccactaaattccagggaatttttgccatagcaatagtaaccaaggcacccaatgacagtgagcttcgccacatcactgttttgggtcaatagcacttgcatcttgtatttctgccatcacaatgagaaaagcatgtcttggcacaagcatgacactggtacaagaaaattgagagatgtgtgtagctgacctggaaaaaacctgcaatctgggccagcccagcccagatcagccagaccttagccaactgccttgcagatgcataaatgacaaataaatgctcataactgtacactactgcaattgtgtgggattgcattgttgttatgcagcattatggtgataactgatacaaggagaaatatgaaagcgagagaaaacattccctgattccaagaataggatacttcttaacttgtaattaggtgggctttatgcttattatcaataacattgtccaatagcatctctatcccggaaaataatatcactctccaattagtaatactggtcccttttctgaggtcctaaatacataagacaaatgacttcacaggttttccttaatcaggtgcctttggcacctcaaaaagaagacaatggatagatagaaaatattcccagcaaacattagctagaattagaggcaccataagccaagaattaagttacaaacccctgaggtaagagatcagggaatcccataaaaaattggaggggtactgatgcatctaagcagtacattagggttataagtaaaaaagcttcaagagattcacttaagccagaaatataggaaaataaactgcaatacaaaagaggaaagggcaataaatatttaccaagaatgctcaggaccaaagtgggaaaccaagaaaacagaagagaggccaggcccagatctccagatcaaaccaaacctcaaaccagagcttactcaggtcagccttggccaaaaggatttgacttttcctggaaccagtggtttgaaaatcattcatagcacataaagaataattatcgcccagtgtcttttaaaaatggaatacaagttgatcaggaaaaataaggaaatgtcataccaaattactcgacaattcatatttggattttcatgttaatttcgtaaaacacatgtcatttgtgaacttactaggtactccctgggacgtcactagacattgagtgtatgaaagttattatgctctttctctggttcaaaaagttggaccagaagggatgctggaactcttactcatctttgaatggctttggggatactgacttgattctacattcaaattcacctcatcacactaaccagagtggcaaaggtgttgagaatatcaaagtctcttggaaagacaataataaaaaaaatttctgaaagaaagatgtactagagccccaccgaactcaagccaagcattttatcactactaccctagaggttgaggtacacaaaacccattgttgcagggtttttgaacaacagtacaagtgacattttgaaccagataatttttcatcatggagacccgtcctgtgcattgcaggttgtttatttagcagcctccctggcgtctactaactagatgccagtaacaccttctcctcacctgcagatatcaaaaccaaaagttgtttttttttgttttttgtttttttgagacggagtctcgctctgtcacccaggctggagtgcagtggcgcgatctcggctcactgcaaactctgcctcccgggttcatgccattctcctgcctcagcctcccatgtagctgggactacaggtacctgccaccacgcccagctatttttttgtatttttagtagagatgcggtttcactgtgttatccaggatggtctcgatctcctgacctcgtgatccgcctgcctcggcctcccaaagtgctgggattacgggcgtgagccaccgcgcccggccaaaagtttttccaaacattgccaatgtcccctggaggcaaaatcactccgagttttttatccttgcgatagtttgctgagaatgatggtttccagcttcatccatgtccttacaaaggacatgaactcatcatttttcataggtgggaattgaacagtgagaacacttggacacaggaaggggaacatcacaccctggggcctgttgtggggtggggggagcggcgaggggggagggaaagcattaggagatatacctaatgtaaatgacgatttaatgggtgcagcacaccaacatggcacatgtatacatatgtaacaaacctgcacgttgtgcacatgtaccctaaaacttaaagtataataaaaaaaaaatcactccaagctgataaccacttcattggtggaacctagccttaaagggccagcttcctaagcatgaagaagcaaaatgtctttgggatgtaagcagataaccaatgggacaagcttatattaaggcagtgatccaaactttttttctgccgaacagattcaagttcacaaacagtcactcccggacatactcagattctgacgtaatatgactagagcttatataagctctactgctttattctgacccaagaaagagtattaaaatgcaagtgagtgaaaatgaaggtgttatggattgaatggtgtccttccaagaagatatgttgacgtccttcctaacgcccagtcgttcagaatttgaccttatttggaagcaaggtttctgcaaatgtagttaagatgaagttattaaaggaaaacttgtggaggaggggccaagatggctgcctagaagcagctgcagtcggcagctcccactgagaagaacgaaaatggcaagtgaatcctgcaccttcagctgaggtatctatgttctctcattgggactgactaggcagttgatgtgacccacgcagagcgaggaaaagcaggctggagcaatggcccacctgggagccacacggggaaaggggagctcccagccccagccaagggaggcagtgagtgattgtgctaccccacctgggaaaccatgctttttccacagatctgtgcaacctgtggatcaggagatcccctcatgagcccacacaaccagggtcttgggtcccacacacagagctatgcagatgctcagtggccactggcagcaggctggagactgcctaagatgaccaagttcctggggggaagggcagctgccatcactgtggctttagactgccatttttccccactggtgccggggagactgggtagtttggaccgggaggaattcccccacaggtgcagcacagcagctgtggcagatcatggccagactgcttctttaggtgggatccagatccattcctcctcaccaggccagaatgtcggcaattccagcaaggggtttaggacaaaactctgatctccctgggacagagcccctggggaaagggatggccacagtatctgtggttcagcagacttactctttccttcctgctggctctgaagagtctgggcagtctgggcaagcgggattcccccaagagcagtgcacccgttctgccaaggggcagccagagtgcttcattatgtgggtccctgatcccatgcctcctgactggtgagacccacccccctcaacaggggtcaccagacatcttatacaggagcattcccactggcatcaggttggtgcctctttgggatggagctcccaggggaaggaacaggcagccatctttgctgttctgcagcctccactggtgacacctctaggggccaaggtgaatagggtctagagtggacccccagaaaactgcagcagccctatggaagaaagtcctgactactaaaaaacaaagagaaagaaacaacaacatcaacaaaaaagatcccacaaaaccccatccaaaggtcagcagcctcaaagactgaaggtggataagcttacaaagatgagaaagaagcaaaacaaaattgctgaaaactcaaaaagccagagtgcctcttctccaaatgactgcaatacctctccagctgagatggatgaactgacagaagtaggcttcagaaggtaggtaataataaactttgctaagttaaaggagtatgttctaacccaaggcaaagaagctaagaagcatgataaaacatttcagaagctgttagccagaataaacagtttagagaggaacataaatgacctgatggagctgaaaaacacatgagaacttcacaatgcaaccacaagtatatcaatagccgaacagaccaagtggaggaaagaatctcagagcttgaaggctatcttgctgaagtaagacaggcagacaagattagaaaaagaagactgaaaaggaatgaacaaaacctccaagaactatgggatcatataaaaggaccaaacctacgactgattggggtacctgaaagggacagaaagaatggaaccaagttggaaaacatacatcaaaatatcatccaggagaacttccccaatctagcaagacaggccaacattcaaattcaggaaatccagagaactccagtaaaatactccatgagaagatcaaccccaagacacattatcgtcagattctccaaggtcgaaataaaggaaaaaatgttaaaggcagccagagagaaaagccaggtcacctacaagggaagcccatcagactaacagtggacctctcagcagaaaccctacatgccagaagagattgggggccaatattcaacattcttaaagaaaagaatttccaacccagaatttcgtatctttccaaactaggcttcctaagtgaaggtgaaataaaatctttttcagacaagcaaatactgagggaatttgtcaccagcaggcctgccttgccaaagctcctgaaggaaccactaaaaatgaaaaggaaaaaccattaccagccactaaaaaaacacactgaagtacacagaccaatgacactacgaagcaactccattaacaagtctgcaaaataaccagatagcatcatgatgacgggatcaaattcacatataacaatattaaccttaaatgtaaatgggctaaatgccctaattaaaagacacagaatggcaagctggataaagattcaagacccatcagtgtgctgtattcttttttttttttttttgagatggagtctcgctctttcacccaggccagactgcggtggcgccatctcggctcactgcaagccccgcctcctgggttcacgccattctcctgcctcagcctcccgagtagctgggactataggtgcccatcaccgtgcccagctaattttttttttttttgtatttttagtagagacggggtttcaccatgttagccaggatggtctcaatctcctgacctcgtgatccaccctcctaagcctccaaaagtgctgggattacaggcgtgagccaccatgcctggcccagtgtgctgtattcaaaagacccatctcacaggcaaagacatacataggctagaaatagatggatggaggagaatttaccaagcaaatggaaagcagaaaaaaagcaggggttgcaattctagttcctgacaaaacagactttaaaccaacaaagatcaaaaaagacaaggaagggcattacataatggaaaagggttcaattctataaaaagagatagctatcctaaatatatatgcacctaatacagaaacacccagattcataaaataagttcttagagacctacaaagagacttagactcccacacaataatagtgggagacattaacaccccactgccaatattagatcattgagacagaaaattaataaagatattcaggacttgaactcagctctggatcaagtggacctgatagatatcttcagtactccccacccaaaacaatagaatatacattattcttatccccacatgtcacttactctaaaatctatcacataaatgaatggaagtaaaacactcctcagcaaatgcaaaagaactgaaatcatagcaaacaatctctcagatcatagcgccatcaaattacaactcaagattaagaaagtcactcaaaaccacacaactacatgaaaattgaacaacctgctcctgaatgattcctgggtaaataatgaaaggcagaaatcaagaagttctttgaaactaatgagaacaaagagacaatgtaccagaatctctggaatgcagctaaagcagtgtttagagagaaatttatagcaccaaatgcccacatcaaaaagctagaaagatctcaaatcaacatcctaacatcacaactaaaaacactagagaaccaagagcaaacaaaccccaaagttagcagaagacaagaaataactgagatcagagcagaactgaaggagatagagacacacaaaaaaaacccttcaaaaaatcaatgaattcaggagctgtttttctgaaaaacttaataaaatagaccactagactaataaagaagaaaagagaagaatcaaatagacacagtaaaaattgataaaggggatatcatcacagaccccacaaaaatacaaacaactatcagagaacattattcatataaacacttctatgcaaataaactagaaaatcttagaagaaatggataaattcctagacacatacaacctcccaagactgaaccaggaagaagctgaatccttgaatagaccaataattaattctgaaattgaggcagtaataaatagcctaccaaccaaaaaaagcccagggccagatagatttatagctgaattctaccagaggtacaaagaggagatggtaccatttcttctgaaactatcccaaataacagaaaaagagggactcctccctaactcattttatgaggccagcataatcctgatagagatacaacctggcagagatacaaaaaaaaaaagaaaaagaaaactttgggccaatatccctgatgaacatcgatgcaaaaatccgcaataaaatactggcaaacaaaatccagcagcacatcaaaaagcctactcaccacaatcaagtcggcttcatccccagcatgcaaggctggttcaacttgtgcaaatcaataaatgtaattcatcacataaacagaactaaagacaaaaatcacatgattatctcaatagaggcagaaaagtcctttgataaaattcaacatcccttcacgttaaaaattctcaataaactaggcattgaaggaacatacctcaaaatagtaagagccatttatgataaacccacagccaatatcatactgaatgggcaaaagctggaagcattccccttgaaatctggcacaagacaaggatgccctctctcaccactcctattcaacatagtattcaaagttctggccagggcaattaggcaagagaaagaaataaaggttattcaaatagaaacagaggaagtcacactggctctgtttgcaaatgacataatcctatatccagaaaacaccatcaacttagcccaaaagctccttaagctgatacacaactgcagcaaagtcttaggatacaaagtcaatgtgcaaaaatcacaagcatttctatacacaaacagcagacaagcagagagccaaatcatgaatgaattcccattcacaattgctacaaagagaataaaatatgtaggattgcagctaaaaagggaagtgaaggacctcttcaaggagaactacaaactactgctcaaggaaatcagagaggacaaaaacagatggaaaaacattccatgttcatggataggaagaatcaatatcgtgaaaatggccatattgcccaaagtaatttacagattccatgctattcccattaaactaccattgacattcttcttagaattagagaaaactatttcaaaatccatatggaaccaaaaaagagcctatatagccaagacaatcctaagcagaaagaacaaaactggagacatcatgctacctgagttcaaactatactacaaggctacagtaaccaaaacatcatgatactggtacaaaatagacacatagaccaatggaacagaacagagaactcagaaataagaccacacacctacaaccatctgatctttgacaaacctgacaaaaacaagcaatggggacagaatttcctattaataaatggtgctaggagaaccggctagtcatatgaagaaaattgaaactggacccactccttataccttatacaaaaattagctcaagacgaattaaacgcttacatgtaaaactcaaaactataaaaattctagaagaaaatctaggaaataccattcaggacacaggcatgagcaaagatttcatgatgaaaacatcaaaagcaattgcaacaaaagcaaaaattgacaaatgcgatctaattaaactaaagagcttctgcacagcaaaagaaattttcatcagagcagacagacaatctaaagaatgggagaaaaatgttgcaatttatccaactgaccaaggtctaatatccagaatctacaaggaagttgaataaatttacaagcaaaaaacaaccccattaaaaagtgggcaaaggacatgaacagacacttctcaaaagaagacatttatgtggccaacaagcatgaaaaaaagctcaacaagagaaatacaaatcaaaaccacaatgagataccatttcacatgagttagaatggtgattattaaaaagttaagaaagcaatgctggtgaggcagtggagaaacaggaatgtttttacattgttggtgggaatgtaaattagttcaaccattgtggaagacagtgtggtgattcctcaaagatctagaaccagaaataacatttgacccagcaatcccattactgggtatatactcaaaggaatataaattattatattataaagatgcatgcatgcatatgttcattgcagcactattacaatagcaaagacatggaatcaaccaaaatgcctatcaatgatggactagataaagaaaatgtggtgcatatacaccatggaataccatgcagccataaaaaggtatgagatcaggtccttcgcatggatgtggatggagctggaagccattatcctcagcaaactaatgcaggaacagaacaccaaacaccacatattatcttataagtgggagctgaacaatgtgaacacatagatacagggagggaacaacatacactggggcctgttgaggggagagaggcaggggaaatgagagcatcaggaaaaatagtgaatgtgtgctgggcttaatacctaggtaatgggttgataggtgcagcaaatcaccatggtacacatttacctatgtaacaaacctgcacatctggcacagtaccccgcaatttaaaatgaaataaaattaaatggaagatgagctcattacggtgagccctaatccagtatgattgatgtctttacaaaaaaaagtgggggagaatttggacacagacttaggcacagagggaggactatatgaacattggagcaaccctgccacaagctaaggaacatctagggctaccagaagttggaagaggcaagacaggatccttgccctacaggtttcagaggaagctgcctggccctgctgacacctttattttggatttctggcctccagaactgtgagacaataagtttctgttgtatatagatttgatgtagaaaaaaaatatagacctgatttaatttttaaattggtataatttcaaaacattagtgttttactagctgcaataaattacttgctgtgcagttacaactgatttaagccaccagtgggtcacaacacaatgggaaaaactgccacaccgcagggtattctgtgttgtgcctcagagaaatttgaaatcgaatttataaaagttattcacttggaccacagtaatctggcatctataaaaatgtatacagtctatcaataatcttaacaggattggggagggggtcagaaaacagatggtcaaactactagtggctccccacttcctacagggcaatatccaaactccttagccaagcatgaaatgccctttgcaatctgatcaccgcctattttccagattcatctttgccaaatcccctcacacctgccttgttccatctggagctgatctggtgccccccacccaagtgttttcatgtcaaggtacacacagaagatgataatatttgagggtgcactgggaaaacagacaaagctgtgtctgatgacagctggcttgggagctccagtcgccccagaccccacctggcagcccaaaaggctaaaaagatcaataaattggtaaacctgtacatattcaaagcatctcaggataccaccacacactactcagttaggaagccctattctaaatccactataatccttctctaacctatgatggtttgaatgttgtgtctcctccaaaattcatgttgcaacttaacccccaatataacagtattaagaggtaggaccttttggtggtgatagaccatgacagctctgctgtcatggatgaattagtgccttgtaaaagggcttgagggggcaagttacccttcctgtcccttctaccatgtgaggacacggtgttcctgccctccagaggacgcagcaacatgttgccatcttggaggcagagagcagccctcaccagacaccaaatctgctggtgccttgatcttggacttcccagcttccagaactgtggaaaataaatattctttataaattacctactctctagtattttattatagcagcacaaacagagtaggacagtgcctttgttttcattcaggaagtcctacctctcaccaagttcaccactcctccaccttgcaaactgctatttatccttcaaaacccagcccaatgaccatttcatctatgacgtctttccacctcccctctgctatactcccactgtacccagtaacaagatccatgtcatggtccttgccatgtggggctgccattgcagctggctcacctagaatgtggtcttccagggtccaggaaccattaggagccaactgggcctatagtgatacagcacatatttattgatctcctgttagaggcaaggcagtgggccaggcatagggactcaagggtagacatggacaaggagggtccctgccctcctagagctcatagcccagtgagggagatggacattaaactgccttccatgcaattgattacttcattacaatggtgggacatgtttcaaaagagaagtacaagcatcaataaatgcacataagttgacctgatctactttaagagtcatggaaagcttccctgaagaggtggcatgtaacagatgagcttcaaaggataaataggaattaagtgaagagaaaatgggtgtgaagtaagcattccgtgttccaaaccaagcattctggttcttgacatcttcacatccacaggcctggccaaggcagatgctaaataaatatttactgatttaaattctttgaaaagtttgagtacctttaagcactttttctctgagtgggttcttccaaaataataattattattttggaaactcttttcaataattcaaatgtacaaatatttattgaaacattattatataatgcaagtctcctagagctcaaggcaaaaagatgagcaagaattttccaggcaaagaagatagaagaaggtattccaagcaaagtagaaaccacatgtgcgtgcacacacacacacacacacacacacacaattatgaaagcaagaaagcacacagtgtggtctggaaatagcatggaatttggttctgatgagtaagggaccttggtaaggaacaaagagatcagggtgtatataagttatctattgctgaataagaaattactcccaacaacacacatttattatttcacagtctgtggggtcatgaagccaggcatggcttagctgggcgttcattaccagcttcagggtctcttgcaaggctgcaaccaaggccttggccctgagactctcacaaggccttacccaagatacctgctagagccgcagtcatctcaagatttgattgaggtaggatctgcttccaagaccattcagtggttgtcagcactcataggctgttggcaggatgcagttccttgtgggctgttgggctgagggattcagttccttgccatgtgagcgtctctgacatggtaactggcttcaccaatggaaagagaaagagagaggcagagacagagacagagaggctgctggcaagacagaaattatagtcttttgtagcccaatcacagaagtgatatcccatctctttttctctcttttattcattgaaagcagttcactaggttcagcccatatgcaaggaatgataggagtcagaggtcactggggacccaatggaagaatcggaagaagaggaaacagcataggagccagtggcaagggcagggcaatcggtaagactatcatgaggccccagtgacaggagaccctgagaaagagcatccaagaaaggatggcgtcaccagcatcaatgctggagggaggcctaggagacaactgcagagaaggtcattgaaaatgtcactgatgtcactggagggaattcagtggagggatgtggaaaccagattatgcgtgcaggacagagggcatgcaaggtgaggggacagagagaaaactagtgtcttcaaagaaatggggcagtcaaggcaagagctggcatagagcagcctcttaagaagagattcttaggctggaagagagctggatgcgttcacagcaaggagggcagggggtggaggtagagactggaaaaagccaaaggcacaagagagaaaaggggcaatgtctatttttgtgtaagattcccaaagagctcaggcagactaataacaggaatttagacctggaggggacagagaagacatctggttttcctcctcttccgactcctcagttactgctaccagctctactctgtgcccatcctaggagcagttggttctcttccctcccgttcctgtccaaacccttcccttctaacacttcctctaagctggcttggccactcccatggtttcagcatgctatcacacctggccccagctcacccctctggcttcacatacatccataaccccactccaccccctacacacacacacacacacacacacacacacacacactgtatcctctagccattctgaaccttaataattcttcaaagctgtgaagctctttgtctctggtccctgggatgtcctgtgtgctgtgctctctgcttggaatactcttttcacacccctcttcacatgaccagatctcagcttagatgcaacctcctccaggaagccttcctgaacccccactgtgtaatcccacaggacagtaaactctgaattgcagttgcctttttacttgttggccttctactggacagaaaactctgtgagagcagaggccgtacctatggtagtcaccatagcttcagcatctagtacagcggttggctccacacaaatttattgagagtagcagatgctctggtgcatggccattatctccacgcaacctgcccttcaggactgaggtgaagggctgaggtatggaattctctccactgctgatggctctcagctgagtccatttctgggcattgctccagactgaaaggagctagcttcccaagggccacatcccttcctgagagcagccatgggtccaatgcctactggcacagggatgcaagaatataaagacctggagacctggcccccttgcctcaatttgggacaattatgaggagccatccaagcttccaagcctcctgtgggatcagcaggggcctcactgtgaataacatcacagttcaactgcccccctctacccaatcctgcttccctcattcccccacagatgttgacccagagagcactcctcaataaacctgcaaatctgcctgcaaatctttatctcagagttggtttcccagggaacctgacctgaggctagtggatacacacaaatgaatttgtccaaatcactcccccacagtaagaatgcagcaggaatgcccaccacaatgtttccaggcaagctcctatggtagcagatagtgggccttcaggagatattgattgaatgaatcaatctggtcattgagcccttgaattcttcctgtgactctcaacacacacttgatgaatctggtttgaattacagtgctgtatttctttggaagtacaaaaaacttgatttatacaatttttatagttcattcagttggttggttaggatgagtctatctgagcacagtatagttgaattctgctgctattgctagaaaagaaagcataatgccaaggccgctctcaaaggacctttctttagacctagtaaaccaagactgaaggcagaggttccagaatgggtgatatggaccagaatcctggtgctacttaccttgccagggagcacataaagagagtctgtggtggccaatgtccatggagaggtgtgcttttggaggacagattcatccaggagtgggtgaaccagcacagcatgttcagagatcaagggccctactgttggctcacgagtagaagaacacccagccagcacttccctaagggcaaaccattctcagccctgaatgtgaacagcacgtaccaaactcagaaattcatctcaaaactagtggtttcatccacttgattgatgttctctttgccctctaggtcaaccacgcttacgtctacatctgtgattagagctatgacccactgaagtcaatggaaaagaaaagagaggataatttttgtgtctattccacgtgtgacttgaaagtttaccaccactcttgccgtacctttcatctgaggatctcctaaatacgtttgtggcgtcattcattaattcctttcacttctctctaaagcactattattcttctcctgagacggagtactttcaggctcagaggggatgagcaattggctcaggtggaagcattcgatgccagaaacacaactcggaactcccaatccttagcctgccttgctgggctagcttgttctggactgcttcccaactacagattcacaaacctcccgtctgttctaattctgcctctaagaattcacacctgagggtgtgacaaccctttctttgcctgataatttatataacatgcaatttccatattttgctatcttaaaagtaagcatgttatacaaatttatggtatttattttcaagcatgttcttagatactgcaattcagactaaatctaaagttatttatcatagtaattcagaactgctgttatagcactaggtttgctgcagatgtaattagttaagatgagattatacagtagagtgggcccctaatccaatatgactgatgtccttataaaaaggggaaatgtgaacatagacacgcactcagggaggacgccatgttatgctgcagtagttatgctgccacaagccgaggaatccgcagaagctgggagggtggaacagaccaccccttgtgccttgagagggagcacggccttgtggacaccttgatttcagacccctggcctccaggactgtgcaaccatacactgctgttgttctaagccacccggtttgtggtactttgttctggcatctgggagactaatacaacagcagtactcaacatatctctaatgtttgcaatgttaaaaccgtaacagtggtcacctgtttataaccaaaagcgaaaggatggacatgagctgagtggtggggagaatgagttggggcctatggagtgtgttataacagcgtgagtggactaaggtggagagagggagagaaacaaggtaaaaataaaaatcagacaaggagttcaggatagggcttgacagggcagtagatgaagggttaggatgagaactattaccttccatggctcctccaactccacaagctagaggctccaggtggttcttcccttgtgtgagctgccacctgctgctaccaccaaataagggaacacagctaccccaggagagaggtgtgccccacgctcccccactccccagctgcttgcttgcctgcctgcctgcctctcagcctcaggaggtcccacctgccagccgccggtggagggagcaggtgcaggcagaggtgagtgtcacatccccccatctctcctgcagctcccagactgattgatgattaaacctgagcatgaaagaggaagaggactaggaagttcagaaaatgtcactcattcatcagaacatctgcgaataaagcagaggtctgaggagtaatatattccttgaaaagctgcaacatacaaggacagtgctgtgagaggaccagatgctgtgagacccacagcataagtgacacattccatgtttccttccaacacccaaaggcacaatagtgagactggcctgctgtgtgtgtcccactgtctgattcctccagcaatcctgcctttccctgaccctgctcatggtaatacacctcacgtggatgcttcagctctagagtcaaactttagaagcatgcaaagatgtgaggtctacgaacatcatgtaactggggaatcacctcaaacaatttcatgtcaagtaaaaaagaatcaatcataccaataggcaatgtctccgtaataaaagaactgaatagttcctcctagaaactgtgtctgccaatactttttattcctacttttttttcccattaagacccaagtctatgtctttactttctggtctaaattatagaatgtattagtttacaaccaaagtgagcacttcccttacttggctggtgcctcagcctctcaggaaggtcctaaggaatccactaggttggaggttctcaacccttgtggatctccaagctgagaaatacaaccccctccagtcagcagctgtgggcaacagctgaactgtgtcccccaccccccaaattcatatgttgaagccctaagccccgatatgactgtctttgtagataggggctttaaagaggtaattaaggttacatgaggacataagggtgggtccagtacactggtgtccttataagaagaggaggagacaccagggtgcaggtgcacagagaaaagaccacaggaggacacaggaggcggctgtctgcaagccaaagagagcagccacaggagaaaccaacttgtaacaccttgatcttggacttccagcttccagaacttcgagaaaatggatttccgttgtttaagccacccagtctgtggtattttattacagcatcgctagcaaatgaataccaatggtaattttcaaccttcattcattcactcagcaaaggagcagccactcagtgccaggcactcttctgggtactaagaatacagcaataaacaaaagagacagagccatggaggaggagaagcatgggagccttcctaaaatgcaatattagaatcttctgctggggacaagtagagtttgaaaaggtatgcatgcaggatctagtttagacttcaggagccaccttcccagtccttgcccctcacccctgccccaacgatcactgcaccagactgacgtgttgaggacaggaactgcattgtcatctttttaaacagagtctgggatgcaggcaatgtcaagaaggcatcctctcttccctgtgccagggacccgattccccagcacccctgctttcacctgaggttctcagcacagggcacctgcaccagcaacatcagcagcccccaggaacttgttagaaacacaaattctcaggccccacctctaccctcttggatcacaaattctagggacccagcccaagcctccaaatgattcttaggcagatgaaagtttgagaaccactgttatccaccctctggcattcaccctgacccacaacttggttctcgctgctctcctcctcctccttctcataacagcagcaatctgtttcttctgccttctgtatgcctggcccggtgtgagacattccacatgctggctcgaagaccatcagtactcacaaggttgagaaaatcatccccatttactgaggaggaaactgaggttcaaagaggcttagtcacttgtccacaagctctcagctaagtaatgggatctggactcaaaaaggccaaagtgcacactttttcttcaggcctttcctatttcactgtcctgttctctctccctattactgtcactcactctattttcttttctttttttgacatatcattgcaccacacaataatcagctcctacctggtctaatgggaatcagctcacctgagccttttgtgatctcatatccagggcttagcaagagccacattctgaaagtaacactggttgatttctgtgtactcagaaggcccatttacactttaacatgagccctccttccttgctgcatggtgcattactaaattccctatagatatttgggaaaatttgatattcttcccttctttataggagaaaaagtatctactataaagaaagaaactaaaaacagtctgctactagttatgggagcaggaatatgaatactataaaatcatattttctattgccattttagacttgcatttggggagcagaaaggtctgagtgaatgaatctgcagtctggtgaaggtgcaatgcctagcaaagaagcaaggcagggctttgtgtctgctctaagccaatctttaagaaacaatggtatgtattggaaggatgtggagaaacaggaagactctgacattgttgacagtaaggtaaaatggtgcaaccacttgggaaaacaatttggcagtttcttaaaacgttaaacataaaacttaccctgggacccaggaattccctagtaagtatctaagagaaacgaaaaaatatgtccacgtaaagacttgtaattgactgtttatggtagtattattcataatagccaaaaggtataaacagcccaaatgtctatctactggtgaatggataaacaaaacaagggatattcatccaatagaatacagtaggtagtataatgaaacatactgatacatgctacaatgcgatgaatgtcaaaggcattctactaagtggaaaaaaagagacacaaagactacctattatatgactctatatgaaatgcccaaataaggcagatctatagcgacagaaagtagactagtgattgcctgggtctggggatggggtgaagattgcctacaattgggcacaacagatcttttggggatgacggaaatattctaaaactgcaatgtgtgttggttgcacgactctgaaatcattatattacacaattaaaattggttaattttatggtgtcaaattatacttcaataaagttgttattaaaatggggaaagggtgtgaatggaaccgtctgagggccatgggctcgagctgtttgattcagtataaccaaggcttattaaccctaaaccacatgtcagcgacaagaagtagcaagctgttttcttctttgataaatcccttgacagacaattcagaggaacagtctccttggagcagaggttctgctgccaagcaaatactccatgaggaatgttaggaggatgggcctgctggtgtctgggccagcaggagagaaagcaaggcaagaccagtgcaaaccgtgcccagcagggctaaagtgggtatcgttgcacagctgggcaagcttgagagaggcctggctcagaagcacacatcaggattcgcttctgcaaggtgtgggtgagctctggcaagctgggcccagaggcaaggagagaagcaaagtcctccccttgtgagaacagtgagggtggaaagcaaacaacaagaggaagaaggtacgtgtctccaaagggagcaagctcttacagggagcttggcaacatttgcatcagcctggtaaaacatcgaaataacaacacctaaaatagccctataggaaccttgtcagaaaataaaggcaagattcctgaaggactctgccttcatccccacggagctgggaagcaaacggggaaatgcaaaccccatttatagggtcacatttggaggagccggctccgtcgggggcaggagggaggaagtggtggggaggctcagggtgtgtcagatccagcctccccacctctgctgagctggcggctggactcaaggcctgccacgtcttcctgctctgcagtgcactagctgtgtgaccttctgcaaactgggtaaccacactgcctccccaccccatctcctccaaggtaaagtggagattttacctgctgcaaaaagttgggtgaggactgatgagagaatgagggttgataagagaaggtaaggcattaaaggtaaaggaaattgcgttttgttatatatataaacagcttctcactgctttcgctggattcatcattctgggactttctgtcttctacatacttttaaaggtgaaggaagagaagggaaaatgtgaaagacaatattccagtctccactgaatgtgtgggcacttcagtctcgtggcaagttcaggccaaggggacagctgctgaaatgtgggggtccaggggctgcagaggggttctgctgcctagcatttaaaagaagagggaagtaaatatttctgaggtgagtcagtaaaagtaaagaaatgcttacttcttgtaaatgagaaggtggcagatgaacacatgagggaatgggcatatattcatcccacttgtaaaacatacttcaaaggaggtagttccaacatcaatttctttatcgtggtactttataagatttccttgtttgcttggttttaattaacagcaaccatacagcattgaaagcgaagccttatccatcatccacgtcaaaggggctggaaaggtccgaatccacctgaatgacaactaaagtttcgagaatgggaatgcaaaaggggattcaaaggtaacaaaatccttgtccttccattttcttcttccgcacaaacaaaagcagtttaatggcattgatggaactgcgtccctctcatcttccccttgcctgctgttgtactcaaaggttccagaatacatgagcgcagccctaccttattttgatgaacagctacagccacagcagaaatcaacagggtttggagaataaatctgataaatcgtgtccttcaaaaagaggaatttatgtaatgctttcagttttatcttgtatgacctacccatcatgaaactgggaaactgtaatttatttatccagtgaagacaaaattgattaacaggtcagtgtaaatgtcagcctgggggaattaacaaatgtagttccaccgggtcagttcttgcccagtactatttaacatttccattaattacttgccgacagaattggtgatagaataggaggtgtattattaaatctgccaatttttaaaaagtttaaatatgaataggtcttggccaattgaaagacagggagggactatttggtatcctcaaggctctgcctggtacagagtaggtgcctaataaatgttagttgaatgaaacaaatgccaacaatacaaagtctagtgtgagggagtccctagagcagcggtccccaatctttttggcaccagggacaacttttccatagaccggtagcaggggaacggtttcaggatgaaactgttccaccacagatgatcaggctttagtttgattctcaaaaggagtgtgcaacctagatcccttgcatgcgcagttcacaatagggttcacacccctacgagaatctaatgccctgctcatctgacaggaggcggagctcaggaggtaatgctcgcccacctcacaggctgtgcagcccagttcctaacaggccacagaccaatagcagacccctgccctagaggaagaaaaggagaatcattaacaacagtttttattaatatctactataaatttaaagccctatcaaaaattacttacagcaatgaaaccatgaccgatccaaatcaagaagatctagacatcagtaatgcacaaaaatcaaatttaacaagcgcaaacataaagtaaggaacatactcatagttcaaaacatgatcacactttttgttatccttttccttatgtgcaggcagacacacacatacacatacacatgcataaatatatattatttctggaatataaatgagaagaaaaggtatggaggaacaaccaccaaagattaactgtctgtcttagcagaaaatagcaacagctaataaaggtgcagctgggtggagaaaaaagaaaaacagtcatacctaagccaaacccctgaagccacaagtcacgcactcctaagtggccgactcaccagcaagcaggatgggatgggatgtcagagctcaaaagccatcaggataccagatccacctctttctcagctgaggggctcctggagttttgtttggtttgtttttaattaaaaagacagaacaaaaagaaaaaaaaatgtcctgatgataagtaacctactggaaggctccgtctgctacccaccgtccataggcaacagcaggatgtaacaaacatacagcctctcatgtacaaaagggagaattcaagtgatgctcagataaagaagtagaacaatgaagaaaaaaaatccatactcatattttttttgagagagagagagacagcatttcgctctgttgcctaggctggagtgcaatggcacaatcttggctcactgtagccttgaactcctggactctaagcgatcctccctcctcagcctcctgagtaactggggcaatgaaattatgcacttagctaattttaaaacaagtttgttttgtagatacagggtcttgctatattgcccaggctggtcttgaattcctggccttaagtgattctcccactcagtctcccaaagtgctgggattatggacatgagccactgcactgggcccatactatgtattttttggccaaataataaacctggatagaacttttcttgagaaaaaaatgagcaagcagacaatacagaagggctattcaataacaacattttgttatctggagaatatgacctgaatgggggaaaaaagagattgaaactgtcatatcaaagttgacatgatagccctaagggagaagtgaggaaaaaagcaaccaactcagaactcaaaggtgcacaacaaatatccagacgtggaatgcacatttcagaaagcaaagtctgaaggagcactgacttgagagaagggaaaagcaatcacccagaagccagagagaagggatcgaacgtttaaaacacaacccccatggaggacacatggcagagaagtttagtttattgtaagaaagcacactgaccactactagaaagatctgattttgctaatggacagataacagggggaagggctactgctggccacaggatggagagtttagaggtaactctgagacatcatttcattatatatcccacagaccactttcacatgccaggcacccagctgggcccacagaacaaaacaaatgaggctcctgccctctaggggcatataatcttataaagtagcagaaaataaacaaataaatacaatgattataaattttcacaggtgctatgtaagaaataaacaaggcactaagtcagaggactaaaaaaaaaaaaggacctgctttagacagaatggcagcgaaggcccttcccaggggatgactgattgattgactggttggttgattgattgatttttccaaggagacaactttcaagttgagatatgaagggtgggaaggagctagccatgggaagaatggaaaactagttccaggttacgggcacgtgaactatgctaagcatggtgagtttgagaagaggatggattgtagtgagcaagatgacagtaccacaaaatgaggcctaagaaggaggcaggagccaggacatgtagaattttccaggccatagtacagaacatgaagagtctactcttagttcaggctgctataacaaattgccagagactgggtggcttataaacaatagaaattatttctcagagttgtggaggctggaagtccaagatcaaggtgctggcagatccagcatctggtgagggcatacctcctggtttgcagatggccaccttcttgctgtgtcttcacatgccagagagagaggaagcaaactctcttcttataggtgtctcttcttataagggcactaaccccatcatgagggcggattaattaattcccaaaggtcttacttcctaataccatcccattgagtttagggtttcaacatacgaatttgcagggacacgaagatgagttctgctaaatatttcttgtaagtccatgaaaagctgagttcctcctgtttgtcagatctgggggcgaggaacagcaatagctagaaggaggaaatgcccagtactatcccagttagctacaaaggagagtggctcaaaggaggcccttgtcagatgcttgtccatgtctagttggctatggagtagatttgactcctaatactgaaatttctaaaagttttgcctggaaaactttcagtgcaaggctaaacattaagtctcttctgtgaatatgaaagtcagttttaaaaaaaaagatccacccatgttaaacctgtcacagatttagtcaatctatttcaaagttaagatctttatagactaggaggcagccatctggaaagtttgtggagccaagatctagatcccttatccaattacatgatgtggctcaagtcatgctatctgtaccttagtttcctcatctttaaaatcaagggaagagaatgtcctgctctctaaggccctttcagaatctaatatgtagaaaatgtctaaaagatgagagcctgcttatataactatctagctgaatgttcagaagtggaaggaaattttggtgccaaactaaaataaactgctcaggtttttcttgcacaagatgtaaaatattattttaccaaaacattatcatattcattttcataattacaaggcttccatgcataacactgaagttctataagtatttgttgaacaagtggtacagctttactgacattacacttttgtgttgaataggacttttttttttttttttttttgagacgcagtcttgctctttcgcccaggccagactgcagtggcgctatgtcggctcactgcaagctccgcttcccgagttcccaccactctcctgcctcagcctcccaagtagctggaaatacaggcgcccgccaccacgcccggctaattttttgtatttttagtagagacagggtttcaccgtgttagccaggatggtctcgatctcctgacctcgtgatccacccaccttggcctcccaaagtgctgggattacaggcgtgagccaccgcgccctgccgaataggacatttttaacacaaatgtatttattaattgctgcccatttcataaactattaagatactgtccttccagcagagtattaaatgaatactatttatcaaatatatttaaacacgatttttaaaaatatgagttagtattggagacagaagtttgtattctttaattaagaggatctctaagggtaatcaattattctagatactgctttgtattgctcatatccctgatcgacaaatatctgtatactgtactatactgaattgtgtctaaaggattctgagtatctgagataatacacattcatttatacattctgctaaatatttatttagtgcctacaatgtgccagacatcattgtaggtaccaggaatgagcaatgaatgaaacaatgtttctgccctcttgaagcttacaagatagtgataaatctataaacatagaagaattaatatcgctaaaatgaccttactacccaaagtaatccacaaattcaattcctaccacaagtcccatgacatttttcatagaaatagaaaaatcccagcaaaccaccatggcatatgtatacctgtgtaacaaacctgcacattctgcacatgtatctaagaacttcaagtaaaattttaaaaaataaaaataaataaataaaaaagaaatagaaaaatcaatcttaaaattcatatggaatcacaaaagactccaaatggacaaaggaatcttgagcaaacagaacaaagctggaagcatcacattatctgatctcaaaatctgctacaaagctagagtaatcaaaacagcctggtactagcacaaaaacagacatagagaccaatggaacagaatggagagcctagaaataaatgcatgcatttacagtcagctgatctttgacaaaaacgccaagaacccacattggggaagtggtgttgggaaaattagatagacaattgaaattagaccctgtattagtccattttcacactgctataaagatataaagattgggtaatttataaaagaaagaggcttaattgactcagttctgcatggctggggaagtctcaggaaacttacaattatggcggaaggggaagcaggcaccttcttcactaagcagcaggagaagtgcacaaggggaaagagcctcacacttatcaaacaaccagatctcatgagaattcactcactatcatgagaacagtatgggggaaccacccccatgatccaatcacctccctcactcaacacataggaattataggtcgagatgagatttgggtggggacacggagccaaaccatatcagacccttatctcatcccatatataaaaatcaagtcaaaatggattaaagacttaaacataataaactataaaactaccagaaaaagacaaaggagaaaagcttcttgacactggatttggtaaagatttcttggatatgaccccaaaagcacaggcaacaaaagcaaaaatagacatgtgagattgcatcacactataaagcttatgcacagcaaaggaaataatcagcagaatgaaaaaataacctgaacaggagaaaatatttgcaaaccaatcatctgatatgggttaatacccaaaatatataagaaactcaaaccactcaatattaagaaaataaataacatgggcaaaggatctgaaaaggcatttctcaaaagaagacatacatatggccacaggtttgtgaaaaatactcatcactaatcatcatggaaatgtaaattaaaatcgcaattagatattacttcacaacagttaggatagctgttatcaaaaagatgagaaataacaagtgttagtgaggatgtggtgaaaagggagtctttctacactactgatgggaatgtaagatagtacagccattatgaaaaccagtagggaagttcctcaaaaaattacaactagaactaccatatggtccaacaactccacttgcaggtatatattcaagggaaataaaatcagtatgttgaagagatatatgcaactcccatgttcactgcagcattatttataatagccaagatatggaatcaaccaaagtgtccatcaacaaatgaatggattaaaagatgtaatatatattggatgaatggaatattatttggcttttaaaaataaggaaatcctatcatttgtgaaaacacagatgaacctaaagaatattatgttaagctaaataagccaggcacagaagggcaaatactgcatgatctcacttgtatgtggaatctaaaagtcaaactcatagaagcagagaataaaaatggtggtccctagaggatagtgggggatgggttggagagatgctggtgaaaagacataaaatttcagttagatgggaagaatgagttcaagatatctactgtacaatatggtggttatagttaataacaacgtattatacacttaagcattgctaagagagtagatgttaaatgctctcaccacaaaacaaatgataattatatgtgttaatgggtatgttaattagcttgatttagttattgcacagtatgtgtacatatatatatacatcacaaaatatcatactgtacatcataaatatgtacaatttgtatttgtcaatttaaaaaattaaaatctacaaaaaataaacaaggaatcatagagcaatctatatggtaaaaaatgttatgaacaaaataatgtgggataggaagactgcactacacaagaataatattttatagcaagtggtcatggaaggcttcattgataaggagatatttgaacagagttctgaagagagttaagaagttaatcaggaggataactaaggaaagggaaaaaggcagccctagctgccatttctgtccaaatttaccttatctgtgtaggcaaaacaacaacaaaaaaagccatagtttattttaaaattgtattagaccagaagtgacctgaagtactcagcaaaagaaaaaaaaatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggtgattttgctccttagttgatgcagtttctcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatctgctgttagtctgatgggcttccctttgagggtaaccctacctttctctctggctgcccttaacattttttccttcacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccacaaatcaacagaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagaacaaacacattcaaaagctagcagaaggcaagaaataactaaaatcagagcagaactgaaggaaacagagacacaaaaaacccttcaaaaaattaatgaatccaggagctggttttttgaaaggatcaacaaaatagaccgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctcgacacatacactctcccaagactaaaccagcaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggtcagcatcattctgataccaaagcctggcggagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattacgtattgatgggacatatttcaaaataataagagctatctatgacaaacccacagccaatatcatactgaatgggcaaaacctggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagatgacatgattgtatatctagaaaaccccattgactcagcccaaaatctccttaagcgataagcaacttcagcaaagtctcaggatacaaaataaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatgaccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggtaacaaaagacaaaattgacaaatgggatctaattaaactaaagagcttctgtacagcaaaagaaactaccatcagagtgaacaggcaacctacaaaatgggagaaaattttcgcaaccgactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggaagtggagaaataggaacacttatacactgttggtgggactgtaaactagttcaaccattgtggaattcagtgcggcgattcctcaggaatctagaaccagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatttcctttgtagggacatggatgaaattggaaatcatcattctcaataaactattgcaagaacaaaaaaccaaacaccgcatattctcactcataggtgggaactgaacaatgagatcacatggacacaggaaggggaacatcacactctggggactgttgtggggtggggggaggggggagggatagcattgggagatatacataatgctagatgacgagttagtgggtgcagtgcaccagcatggcacatgtatacatatgtaactaacctgcacaatgtgcacatgtaccctaaaacttaaagtataataataaaagaaaaaaataaaaataaagaaaaaaaatcctctctggagagaagcatgttatcttaggcctcaaataattcccacaaattattttttaaggacagtgatagacttagcaaaaaaaaaaaaaaatacccgagcagcctaggaaacaatgtattataagcagaagcaacatcagcagaaacagataagccaatgctagcaatattggaattatgaaattgatgcgatttggcgctatgtccccacccaaatctcatgttgaattgtaattcccaatgttgggaaagggacctgatggtaggtaattggatcatgggaacaggtttcccccatgctgttctcatgatagtgaatgagttcttgcgagatgtgatggtttaaaattgtgtggcatttcccccatcactctctctatctctcttgctgccatgtgaagaaggtgcttgcttctctttcaccttccaccatgactgtaagtttcctgaggcctcccagccatgcttcctgttaagcctgctgaactgtgagtcacttaaacctcttttcttcataaattacccagtctcaagtagttatttatagcagtgtgaaaacagactaacacagaaatgcaaactataaaacaactatgcttatcatgttactatgttcaaatatataaagtataagcctatctgcacagaacaaggatctgaaaatgacatcaaagatttgaaaaataacccgagaggctccagaaactaaaagaaaaaaaaggatcaatgactgggtttaacaagagattacacattattagagagagaattagaaattacctaaaatatttcaaagacagacagtaacaaaaaatataaaagaaagtctaagatacagagaggaaaaagtccaacatacgttttattcagagtataagaagggtgagagaatgggcagaagaaatattttaaaagataatcaccgagaattttccagaacaaatgaaagatgttgatcacgagtacccagtgaaaggcccagtgaaacccaatcgcactaagtggaagaaacccactcctagacacatcacagtgaaacttcacagaattatgacaaaagtaacagaagtgagggggaaaagaaaaccagagaaaattaagattaccttcaaagagtgtagttgtcttcccagcagaaacagtggaggctatagacaataaaatgatatcttcaatgaattcaaagaaaacaattgccaatctagaattgtattatcagtgaaagcatctttcaaaaatgagagcaaataaagccattttcagacaaaaactgaatttgctaccagcagacactctctaaaagaaattctgaagaattttcttcatgaagaagaagaaaggtgatcccagatgaaagatctgagatacaataagaaaagcagaaaaagtaacaaagatgtggataaatctaaattaacactatttgcataaaacatcaaaaatgccttgtcagttaaaaaaatgataggaataaaatgcatgacaacaataatttatgatcaggagggaggtaagtggagttaatgtgtcctgggatcattgtatcattcaggaggaaaataaaggtattttgaagtaattttagactttgatgagtgagatatgcctattgtctctttttgggttcatctctttttccttcagctccatcacagcatcagtccaaatcagcttgtaacattaacctccagcagaggccaaaccacacttgcctctaggcagtgagatgttttgccttggttcacgtatcctcacctcctcctctgcctcaacaaatcaccccaaatttactggtttaaaatagccattttattaagctcctggaatctgagggtcagaaattttggcagagaacagcagaaatagtttctctctgtgccactatgtctgtggtctcagcttggaagattcaaagagctggggtccagaggcagtggctcacacctgtaatcccagcaatcaggaggctgaggtgagaggatcaattgaggccaggagttcaagaccagcctggccaacatatcaagacgttatttctattaaaaaaaaaatagctgagcgtggtggtgtatgctgtagtcctagctactggaaaggctataaggttagaggactgcttgagcacaagagtttgagcttgcagtgagctatgatcatgtcactgcactccagcctgggtgacagagcaagaacctatctcaaaaaaaaaaaaagagagagagagacagagctggcagtaactctaatggctaagggctggactcatagagtcccatagagataactgatatatctgacacctgggctggggtggctcaaaggtggggctcctttgagcagctgaccagagcacccatgcacagtttgggtatctcatagtatggtagctggattccaagaggtagcatcctgagaggaaggatgggaggatccagggaatgaacattccaggagaaccaggcttttcctgacttagccctgtgtattaatttcccattcttgctataatgaattatcacaaacttagtgccttaaaacaatacaaatttactatcgtacagtttgggaggtcagaagtctcacatggatttcactggaataaaatcaaagtgtgagcagagctgcattccttctgaagactcaggggaaaatttgttcccttgtcttttccagccacctgcattcctcggcccatggccccttctaccatctttgaaggcagcagcatagcacatcttcgaatctctctctggccctgaaactcttgtctgtgtcttatgaggacccttgtgactacattgagcccacccagataatccaggataatcttccagcctcaagatccttaactcaatcacatctgccaagtcccttttgccatataaggtaacacacattcacaggttctgcagattaggatgtgaacatctatggcagggggagggaacattattctatcaactacaccttgggaatcacatagcatagcatcatgtccacagtaaagactggtcaaaattgtcacagccagctcagattctagagtaggggtcatagacccaacctctcaatggaaggagtgccaataaatgtgtggccatgtggccttggtttgaaactaccacgcctttcctgttgtggctgctccacattggctaacgggggaggagcttcacccccatttttgactcagcaacacgaacatgaaaagagatggacagtccagcagacattgaaagggggcaaaagatacgccatgcagttgcacttcgtgtaaattttaaatagtatcacatacaaaattaataaaccttctctttatgcacagttgaagccaagaaaatcttactttatatttattcctaactgaaaactagactcgaattgtgcaagttttaaattatgtgagttttttaggaatgcatcctctgcataaaatgtgaatatgctgtacttgttctaattctctaaggaccaaaacaccatataacatgaagaaagaaaacagagaagatgtgaaaattacatccaactttgagcataaggattaaagaatcaccaaatgattaacttccctcaaaatacaagtttcccatgctgtttgaattgaaggaatttttttctgttgaaatcaagcattattagtaaacagcagttgtgagaactcgaaggggctaaattgtaggctttgttggaaacaggcctgaatagaacatattagcataaattgtatttttatggttaagctgcagtgttaaatatcaaactgtgctaaacgattgattccatacagctgctaaattgaactacctgttatatcagtttagtaaattgtcaaacttagagaactcagcaatttaatggatgtgtttgtaaaatatccttaggtaccctggcttaacatcaagaaacaaaccaccctcttagagtgttaaaagtctgtctgttaaaaaaaaagattaacaaggggataaatataagattaatttttaaaaggaaagccaatatactataaaatgaacataatatgttcagttcatagttcatgtcaaaaaagttcacattctatcttaattttctctacattaagtattaaataatttttgccttatcactatattatcattcaggacactggatactgaattttgcccagttaaactcacaatcactatgtctccttccacttttgactctggatatttggcatatttaatcaaatgaggggtgaaaattaagcaaaatgatgtcatgtcatgatgtcatactttttgctaaattttatatattctttaggaatactgagcatttcagataggtctctgccttctatcttataatggatgtttgtaaaccacacagcagatatttaatatcctgagaataaataccttgtgtatggcttagttctgtcaaatgtaaaattaagcataaatattagtattgaatgccaaagccaattgttgaaaatcagatcataaaaacccttatttgaggtctattaacaactgaccatttgaaataatcagggattaattaataaatggtttgcttatgtcttttatataacaagaagattgttagaaaataaaataagctatcattatcacttccttcatgtgattttgccactcttattttgatagcatctacataatagagaatcatttttgctggtttttaatacttttctctctctctttttttttttttttttttttttttgagacggagtcttgctctgtcatcagactggagcgcaatggtgcgatctcagctcactgcaacctccacctcccaggttcaagtgattctcctgcctcagcctcccaagaagctgggactacaggtgcatgccactacactgaactaatttttgtatttttagtagagaaggggtttcaccatgttggccaggatggtcttgatctcttgacctcatgatccacctgcctcagcctcccaaagtgctgagattacaggtgtgagccaccacgcccagccataatacttttttctaagtataaaagcaacgcatgccccgtacagaaagtgtagaaaatataaaccaactaaacaaaaaagttaaaatcctccataataatttattttaaacaccctgaatcagattctcattcttgatcattaaaggcaattagaattggagaaaagaagtgagtataaaaattaactcataaaagtgctagagggagatacaggtgattttaatgggcacctctctacagtcccacccccaaaaccctaattaggagaagaccaagttcgcagctcacatcaatgggcattcaagtcagtgccattagaatctcaaagccaggatgattccagaggacacatgggtcacttggacaattgagtataacacactacaaattgagataaatagagaaaaattaaagtgctatgggaacccagaaaggaagggaaaggatctgagcagcaagatcaaagatgattgcagaagaaaaacatttgaatggaactttgaatggtgaacaagccagcaagaacctaagaagtcaaagggaacagcatttcaaagagagggaacataaaggaaggcacagagtggtgaagtccaatatgaatggttccatcatcaggtcacagaagtaccttgctggcccattcttaaagcagcaaaagagtcaagccacgcagcaaattgatccattcttttttttttttcaaacttttattatgaggccatattagggaattctagaaaatctagtgttattaaatatgtccagactctactagtgaggaatcttttaatcacagttgacagaaacccaatttaaactagcaaaacaagtgggaattcattaattcataattgaaaacttagtgtgtagactggttcagctaaagctggacctaggtactcaaatgatctggttgtgtttctgtttccacttctctttctctgctctgcttgtatccacttctctttgcatgttagtgttactctttcctaccatagatactctttccatatcccaggaaaggtagcttctggtgggcctaggccaacatccttacaacttgctaacataaatgaagagaatagtcttccctcagtagatccaggagaagaacccccagggggcacctttgtagcccagattggacaaattgcccttccctaaaccagccactgtaaatggaggaatgtaatactacagctggcccactgcaggtcactgcccatgtgcaagggcaggaggaggcacaagtcaccttcatggacagccccaccaagatcacatgaagtagaggagcaggttcccaaaggagaaagaggaggatgggagagtatgctcagtacatgacagctataactagcacagttgatctgccaggtatctgaggactcccttccatctcagcagtggggatacatcaccataagccccagacagttacttgggaagcactgcagatggatgacagttctcctgcaatatacaatgatgagaaatatactaaagacactttcaaatcagcacccaaaaaccctcctgacaaagatttttctcccaatactcaaaatggaagactctattgaattttaaaatagagaagcagagcaaccaatcgctccccagctcctcccctagtaataagagtcacctgttttagctcttgtgtcttacattagcatatttgaaatctggtcatttaaaattagatcataaatggaacaagcatccatatggcactgaggatgtgccaggcactattctaagtgcgttacatatagtaatacttgcaacaaccccatgaagcatgacctactattatttccatttatggctgaagacgccagagcacagagaggtcacaccacatttaagatttgaatccaggtggtctgatccagagtctgtgctctttaccccaaggttagacacagaacctctactccagataggtcataatgtaaaaatggtgagcaagggaacaggaaaaaagggacacactgaaaaagaagagtctgcaacagaataaataagcagatataatattagtaacataacctagacactgaactgtcagctcagaagcataagtctgtccgcgtagccccaacattgtctatggagggtgtgagcagtctggtttaacaaatccaggttaaagactcatcacactctactggcatgaaaatatcctctccttttccacagatgctgtgcccataaaggcagcctggtgtctggagataacctcactacacagtgcctgatacagtgtctgctacattgtcatgctcaatagtgttcctttaattttccttaggagagccataagagctgaaagactagattcaaggatcaagtatttattgattacctactatgtaccagaccctgggctgggccccgaagacacagcaatgatgagacaggcacagctatgcacccacagtatcttccaccaagcctggctcatcacacacttaagctgaggttaatcagaatttttggcatcttttacaagcagccctggtatctagatggtatacacctgtacagacatactgcttggtaaaatattgaaatattttgtactacttgataaacagtcactgcctaagtctccggggtatctcaccactacccccaccctgccctgaccccactctcaggaaccccaaacattccccatgatccatcaactggggggtagcccgggcctggcaggggacacccaagcccccattccagcatatgtcctgcacttgttctgattggtgggcaccaatgcccctgcctgtaatcactaaaagtagccccaaatccccctttccacaagcttttaactcacacttttctgattgactgccagttctctttagaaacggtaggtctttatttttaaaaaataaaataataaaataaaataaaggagaatcatcagacacacaatgtgacaattagcaactgtctgacaatgactcgctgacgcagaggacatcataccaagatgggaccaaattacctcctcctcctctgccacccactgcagcttctatcagcagataccttcagaacagaggccccagtgacagggacccagatggcccagcaaccaagggaacgggcaggaccttctcaccttccctggcctctcacagacacagactcctgctggctgtgtcagtcgcgaaagagtgcaaacaacaccactcagggagtttcacccatctgcccacatgacacctcggttgctgggaaatccctgtacctgtccaggtgccaggaaagatcaggactggctctgacagagatcttcaaaaaccagactcaaaggtagtagggttccccatgaacactttgttctcaaccttggctgccccttagaatcactcaggggtgcttttaagatatagatgccaggccccagccaattccatcagcagatccagtggggcctgccatggcttaggggactccagatatgggaactgcctccaagggccagtcagatggacccctggggttccactctcctgtacaagtcagtagcccaaaagggaaacatccagacatcattctggctccaggttccccctcccaccctgcccacatgctcatacagcagatggagctttgagaggtgtcccctttccactgggggaaaggtcctgagaataaagggttctggcattttacccgcacatggtagctggacagtaaggacaagaaatacatttattcaaatcctaatatgagactgtgagtttattagcatcattcagtattatcttttagagatttctgggttttttttgttctaactgctaactaatatttttaaatatctagaaattaatatttaaagctgacttctcttttttctttttttttaatttttgagatgaagtcttgctctgttgcccaggctggagtacagtggcacaatctcggctcactgtaacctccacctcccaggttcaagcgattcttcttgtctcagcctcctgagtagctgggaatgcaggtgtgcaccaccacgctcagctaatttttgtatttttagtagagatgaggtttcatcatgttggccaggctggtctcgaactcctgacctcaggtgatccaccctcctctgcctcccaaagtgctgggattacaggcgtgagccaacgtgccccacctaaaaagctgacttctcaaaaacaatatcatacaaaagaataaaacataatataaatgagcccctgttgtttctgagctgttttccaaagcaccctgtcctttactcagcaaagaggtccttgtccgtgcacatcgaagtcgactgacagagccagaagggagaacagtggcgacagaagacaaaccaccttgggagcaagtcccccaggcactccttcctggcacagatcctgaaatcatgcccctcccatgaggctgcccagattggcagcaaaccaggccattgagttcaagaacctccagaggtctcctttctaaagaaggatcacatttcctgtgctgctgacaaggattataaggtgcagggaggtaaaggggccaagtcaataggcaaatgtctttttagggcaaaaaaaaaaaaaaggcactctcgtcacctcaagagtacagtaaagagaaaaaacctcggacatgcctctgggggagacataagcttgagatttttagttaaattaagctgctgttaaatgtgtcgtttttctgtctcacaaattttgccaccaaaaaaaggaacaaatcaatgcaaatgtctcaggttaggtactaaatccgggcagagtgacaaggcatctcatgttgtaggtcacccctccacactgcaactgccaagtaaggaaaggaggacacaacctcactgccacctctcccagcaagtccgcctttgcaaagtggacaccaaccaggtggtggagcaggccccaggcatgacccaggaggaaagaggagaggaaaacaaatcaaggaagcaaatcagagagctcaggaagaaatcagaagcacacatgttcaaaacaggtagagcccacatccatccactgtaggcattctaagccttaatatgtggcaaagacagcaggggctcatgacttctgattttctcagtcaagggcaaaatgtatcctccctattttaataaaaaagcaagatttaattatgtttgcacatccagtggttctagaaataaggaagaaaggggagctttttttcattacttttgtatatcaccgtctttccaaaaacctaacaactaggtgacgtgggcagctgcaacctctctgagttactattgcatcatggggccagaatggttgcttggaaggcaaagggtcagaactgccgaccgcttgagctccatactgtatgatcacatgaactcttcaggaatgtaagttacttatataaagatatgttcccaagcaagttgtcaatacattatacctaaaaatacaccatggaactattaggaaaatcctatcacctattgagcagtggttctcaaagtatggtaaccaaagcagcagcagcagcatcacctgtgaacccattagagctgcaaatcctcaagctccaccctggacctactgacttagaaactctgggggtgaagcctggcagtctgtgtttcaagtcaccattgtgatcttgatgactgctacagcaactcatttagtaagcaaaatagctcctaacagatgtgtttcaaatattagagtttgctgtaaatatgtctgtcgcctagttctaaatcctttgcttcgaacggtcaatatctgtttcagaggggacaggaaatccccacgctggcctccttgctgtcctggacactccaccttagggactttgccctggccattcccgctgatgggagcactgccccctccaccctaccccatacagggcttggcttaaatgtcatcatctcagcaaggctaccctgtatccctgattccccttaccttgctcactgttcccaaagtattttgcccttctaaagatctatataattcacttactaatgtacagggctttctgtatgtctctcaagtggaaagcaagttgctgtcatggcagtctgtaatgcccagcacatagtaggtgtacacacacagacacacgcacgcacacatacatatatatgtatacatgcacatatacatatatatgacacacacatgtgtatatatatacacacatatgtgtatatatatatgtctatgtgtatatatatctacacagatatatataatgaataaatgagtcaggcaaattccaggataaacctttgggtgcacagccttcatttattttgtaaaggctcaaacgatggggggctacctttataaactggagagaagtttccatcgcccatggaggaccccagtgttggttcccatgctgcatctttctgaagatatctgaatggttgataaccttgttttgcaaccaacattcaggaaagagtaagttgctggaattgcactatgaatcactagtgaagatgctgcttgtagaaatctttgctatcagttgaatgcactactcatctgacaatactttctttcaaataaagccttcaaccatgtttaaaaattgcacaactattagaggtaactaaaatttaatacttttgcttctagcttaaagtgagaaatgtagaattgtgccaaaagctgataatctcttcttggctggttcagtgagagtggtttagaagtaaggtctccagtctttcataactagtttcttttttatgattttcctgggaatttccagttccagatatttttctataaaacagttctacacagatagctttaaggtcacgacaagttaaaaatgaatgctgaccattagaaaagatcgttggatcattgctagatgttttcatgcaatcttccccatttcctccagatgataaaaccatatgaagcaaaacttggaaaccaagatatgacagaagaccaagctaaaaactacaggtgtgtctttcagtgtgcatgtgttgcatgtgttggtgtgaggggtggagggtggggggaggctgaaagagacaaggaaagagacagggacgagaggaaccaatgaaataaggtgtgggaaagtaccctgctaactgcaaagcaccagagcagcggttctgaaactctctggtctcaggacctccttacattcttaaaaattactgcagaccccaaagagcctttgtttatggggtaatatctatattatttgccatatcagaaagtaaaacaaaaattactaaaatatttattagttcattgtcaataacctcattacatgttaacataagtaacatattttatgaaaaataactatactttccaaagccaaaaaaaaaaaaaaaaaactgtgaaaagagtggtgctgtttcacactttagtgagtctctttaatgtctggcttaatagaagacaactggatcctaaaatctgcccctgcattaagtttgttgcaatgtcataggtcctgtgacctctgtaaagcttcactgtacacccgtgagaatgaaaatggaaaaggcaaattgcatcttagtattattataaaagtatttttgacctcatggatccctgaatgggtttctcagagacccccagggacccctagatcacaatttgagaatgaccgtactagccaaatgttatcgacttatttcctatttagagaaagataaactgagactgagagagaggaagttctatgatttaccaaaggtcacagcagggagtgggaaggaaggcagcataacttaggctaacttctgatgagtactctcagcattggactatatgtgtttccacgtgtacagaagcttctgcctaatctgagtttttctgagtaataagcacaattatgaaatacaatagagctgagtcagtcaagtattcaacttacatggacttgggtctatgccctctgcttacccccatctccaccacagcagagagagagcctgatcaattgcatgtaccatttcattgcaaaagcacatgccctcgagtgaccgtgaggtagggatgtgaataccccagtccttcatgaggctcactgcagttctcttcaagtgtgagcattttgacatcttgagtgggattctagagattaagacatttttgttcggttggttcagtttggtttggtagcatgtggcttgtgaatgcaagaaacaacaattgaatgggggaacaccagctttaccaagcttattgaaggcagcacagtctctagtgctgcaggtagagtatttgatgggcaatttaaggattttcaagggtaactggctttttgccatctctgaaacttcaccctcacttaggggcaagtcttctgacaaagctgagttccagtgtgatagcaacatgtgagtgatggggaggcttgtgatgacagcagaggcgtctgggtgatgggagaagacactgacacaggtgcaagtgcacactgttcaccagaaatacatggcacttccactggggcttctcagctttgtcggtgccaatgcttactactcagtattctactccataatatgccaatatttgtactaaaatggttatcgcaaaagtaatacattcatttgcttaaaaaaatgagtacggaagagtagagatgtcttactctgactccacccccatgacagtccatgctctagaggtaacatatctgtttctccctttagttcttctgatggattccttcataactcgaatgcacttacatctttatttcttgctgtatcccttttaaaacctcccacgaagactcacctatattccttccacttcatctcctagactccaaatgtgattgataaatttacatcatattctgttattgtattttccatgctttgtttttaaattgactctaaaacataaaaactagtaaacagcactgaaaatatgatggaatgtacagaaccaagaagtctgactgaacccaaaagaacaaaatgtgatcctgtcacatgaaatctgtgccacttgaagaataatgtttcaagtgtgaagatcaagtggactctctgttccttctctccaccaactgctgagaaccaagacacatttttgtttcctttgtatgtggattatgactttgtatttttcccagagttcccaagaagaaaaaaagaaaaggaaaggcatatgcagcatcatacgataaagccattattagttctcagctacacagtttctgtaatggaatcactttctctttgaagacactgtggcttcttctgattgttggcagctgctttctaaatcggctccacaattgttatactgggatttcttttcattgccctactgggttatcatagtttgttggatccaacattttaaccatttcttgatcatttgttgtttggctggagatatcctttaatagttgttctttttttggaaaggctatatgggaagtaaacttcctgaattcttacatgtctgaaaatgttgattttactcacacacttaattgttcacatggctggtacagcagacactactggctgtcacaacattcatctactcccaccccaatacttttcataataacatcttcctttgtacaggtattctccttgtccgtgtgtccacaggcagtggtctacctattacccttacagtgattggtttaggaatagacacgttaaaatttggtaaataagtcttccaggagttctgaataaaaggcattcccattttcctctgcagactgttatttctgactgtggttcctagaactaccgtggatatcttgtcaccatagaggagctagcctgagcacaaagccaacaagctaaggagacgctgcaaaataacagaagaatcaggaatcctgttattatttgtcattattaagctgataaatttaccaacgctggtgatgcccgacctctgaatttcagaaaacgtgagtatagaattattagtttactttcccttaaaactttgaaagcattatgccattgtctactggtatctattgtatcgattactgaagtaatatgtgaatctacttcctatttctttgtgaataatgtcgtttcccctgttgctgagagcttttattcttctctttggtacacacaggtagggagcaggcaggtacatctggaactccaccaccttcaaaggaaactaaggcatttaaatgtatttccttcctagtgggagatgactttcctttttaccctctggctctacccacaggatttcctttttgtctgctgggtctacatcagatattattctgcattgcttccttgccccaatttcatacttttggatgtcccttagcaaatcattcataagtttggaaaaccattcttagaattcaaattgctctatacacatcttagaaaggaaagagctacttagccagtgtgtaacttcattcccagagtattgaaattcatcataatgtgtcttgatctggatctgttctcatttatcctgcttggcactcagtgggttccttttgattgaagaatttgattcttcctttagctcagagaaaaattattccattatttcttcatttcttttgtatatactatgcagatattggaccttctcaaactattatattgtctttttacatatttcttaaatttgccaccttttctagtttctgaaagattttctcaattttgtctcatttacttatttggaatatatcatgtccttttaaaaacaaacaaacaaacaaaacagggtcttacctgttgcccaggctggagtgccatggtgccatcatagctcactgcctcagcctcctgagtagctgggattacaggcacataccaccatgcctggctaattttttttcttttggtacagacaggatctcactatgttgcccaggctggtctcaaactcctggcctcaagcagtcctcctacattggtctcccaaagtgctgagattacaggtgtgagccactgtgcccagccataataacatgtttttcatagcagtgagtcattgttttatttatgtaaaaatctctgaattgcttttaatatctccatatcctctcaagtgacttcttgtttgtttatcttggtctttgtctcttatgttgttgatctccctcagatgtctggtggtccttaggagatcctttatatttgttgctgaaggactgtagattagtataggtagttcatgtgtgtttcctttgtagttaggcaggtctatttgctctgaatgtgagggctgactctagcctttgtgtgcagagattcttctctttggtacatgcaggtagggagcaagcaagtacatctggaactccaccaccttcaaaggaaagtagggcacttaaaagtatttccctcctagctggagatgactttcctttctaccctctggctctaccctcaggatttcctttttatctgctgggtctacatcagatattactttgcagtgctttcttgccccaacttcatacctttggctgtcccttagaaaatcattcataagttcagaaaaccattcttagaattcaaattgctctatacacatcttagaaaggaaagagctacttaaccaaaatgtcccaaggacatctttccagttaaccaccaagaggagggatgtccctgctctttaattcatcccaccccacctccaaggctcagcccagaccactgtttcaaagctcactcttgtcctccatatgtgctaattcctagcttggatcctgtctgaacaaggtctccctcctctgacacaattcttcatttagttctaggacacggtttcccactgaaataacaaactgcaagcccatctagcttgtcttgatgaaatatcttttctacccacagcactgcctgctgttttcagagttgtcacaaattttttttttctagatgcctttagccaccatttcagaagattccaagaaggcaggggaggcaaacgaatgtacttagtctgtcatcttgaaaaagaatcctgtgtacatttctattaacacaagtcaactttctttcaattcttttgacaatgtagagtttcagagtatctggaaaaccaatataatgtggagggcaagggattagaagtgaaaattgatacactgagtgaaatattttaaaatctagactcacgtgtataaagtcaaatatattttctctttataaaaagaattagtttctgtattgacctcctattcccttcaaagttagaagttaaatctaggttatttccaggtaaactcagttacttctgggtaaaattaatcatttcaagcttaacttgatcaattcaagatatcacaccaccatcacccttcttgttagggttctagctaaggtttctcaggcatttggggacatggtgcctgccctggcctccatcaactgccttctttccacctggtcattgcccattggcctctatccctatcaaatcctccaccgattctgtggtcctcatgttggcctcaaagcctcaaggcagaggggtcgcccacatccttctaatctcaactacgagctcctttcggttcactgactcccttattcacaatttcttcctccatctgcctctttgctatttccaaataaattatctatagaccaggagttttggacactgtcctgtgctactctctagtctctaatgaagacatgctaccctgcccttttgcactttcgctggtgctgtaccatgtggacacaaggaacttctctacagggcctcatcctgggaaacaacaagaatgggaagtgacatagggatgtccctgctcctctcaccccacctccaaggctcagtccactgcaaaaaaagacaggaaactaggtatctttccatgaacccactggaatataaaccctggaacatttcctctggttcctccctgtccctgacttaggccatgtttagctagtttacagaacagggtacttttattcttcatctacactgccatgttttattgattctaagatgtagtacatttctttagacatagatgtctcttaaaattgggaggtaccttataattggtgacctctcacatgttatgaatggagtgtttgcgtaccccccaaattcatatgttgaagccctaacctccaatgtgatgttattaggaggagtggcctttaagaagtaagtaggtttagatgcgtcatgatggtgtggtccccatgatggggctggagcccttataagaggaagagcattttgtgggggcctaggtgggcggatcatttgaggtcaagagttcaagaccagcctcaccaacgtggtgaaacctcatttctactgaaatacaaaaattagccaggtgtggtggcaggcacctgtaatctcagctacttggaaggctgagacaagagaattgcttgaacccaggaggtggaggttgcagtgagccaagattgtgccgctgcactccagcctgggagacagggcgagactccctctcaataaaaataaaaataaaaataaagagaagaggaagagactagagttctccctctctttgccatactgtaaaaggcagctgtctacaagccaggaagagggccctcaccagaacccaaccatgctggcatctgatcttggacttccagcttccaaactatgagaaagaaatatctgttgtttaacccacccagtctatgctactttgttatagcagcctgaacagaccaagacattagatgtgatgaaacacatttccaatctgttgttcatggcaaaactttatgccttgtgtattagtttgatagggctgccataaactgagtggcttaaacaacaaaaatttattgtctacagttctggaggctaaagtccaagatcaaggtgttgaccacatttgctcctcccgagggctgaaggaaggatgtgttctaggcctctctccttggcttgtaggtggctgtcttctccctatgtctcttcatactatcttctctgtatgcatggctctgtgtccaaatttctactttttataagcatatcagtcatattggattagagcccacactaatgacctcattttagtttgattaccactgtaatagaccttctctccttaatacagtcacattctgagatactagaagttaagatttcaacatctgatttttggggagacacaattcaacccataacacctcagtttcttcaaagatttgcttttgatgttcaagcccaaactcttccatatgaaaagtcttgctttgtctctgctatgaatttgaaaatacagatatttaaaatctcaacaggagccctacctgtttatttatctttacattcctattataacagtccaaatgcttccagcaatgaattaataacagaataaggggagggccatggggaaattttaagggctggggaaggaagacatctctattaatatttcaaaattttgtacaacttcattaaatcagcccaagctgccaaatgtgctgggtcaaacccatagcagtcttccacttacaaggaatactttaggtgctgctcagaagtctccattttagtccttcccaacagcagagaagcagaaagacaccccaggaattttgaagacataacccaaagcagcttaccagaaacaagaaatttttacatctcctgtttaatccttaaatgccacatgaattttacattgccctccataatattcctctacccatgtatggcaacagcttttacgaggaagaaaaagtcaaaactatttccccccaaagtttcaagcagcatccgggaagatgcacccagtctgtcctatgatttcatgtgcccctggcataatgccccatgttggagaagcacggctttcagtggaggaaacaggaagtttcacagataaaggggttttgttttgttttcagcagagaaagatcttcattttggcactgccaggaagccagtccttttccacccaaaggacagcatttcctgaagagcagatacatgtcccttcccagctggtggagagtctgccaggtggaaaggaaatggcatgccacaaaatgaacaatacagctgcatttaagcaaggatgttcacatcacagagaaagaagggaccaaaggcaagcagggtgagagttcggggaaaggagaaagtcacgcggctccagcacacagcaaggaaggagggggtgcaaagcacaagcaggaggtggggaaaaggcagagaaaggtgagaaaatggatgagctgattcggacttgtggcaaagatcagcaaatctgaaatgatggcgggacaacagagcacaaataaagctgcgccaacaatatccacatcctgagcttcacagagtacctagaatggccacaaagaaataacctcctctattgtaggtccagtgatgccgatctgtcctctcatttccatcagcttattgtgttgtgacatctgctcaggtgaactttctaggcaccaatgaagctgaagttactgagtgatatccaaaattcactctaaatgctatgatcaataacaaatttaggtctgaaaattacttaaccaacccttgaatgaatgcaagtcaatgacaagaattttccctcaaatttaatacgttaaagaagggttccttgttggtttttatttgcatctcttagtttattcagcatcaactctgagtgcattccaggctgggctcctgtacagtcatgtccagaaaggtctcattctgtggctttcatctttccttactccactcacataaagatgagatggcaaacacatctgtgactgtcaggcctgttttggcctccagaggtccgtgctgctggtggtcagcagccctgtggagaggcaaagccagggagaaagtgagacagcttccgaggatcatgcttaaggaaatccccggggctcatggccaacatcaaaatccaaccagcaccaccaccaaagcaaagaaataaaatcagaattcttctatttgttatgaggacaattctcagttttcaagctcaggtatgtaaagaatgcaacttacctgttctctaatcatcttaatttataatgcaaccctctgttagagactaattccatgcaattcaaggtctctcctccaaccccatctccccagaattaagtctacattccagggccttactcagtgagtgccaaagcctctgagccttgcctaaatacaggggcatgggtttcctctgctctctggcatgccagacctgtgaggggtttgcatggtcactgcccttcagaattcagcgtagacacagagcaagacctgcctcctaaggaaccacggacatctgcctttcctccttccctccagctctcctcctctcttctcaccaaggacaatatcaccccattaggaaggggctttaaaggtactaaagaagccttttcttactcatgggcatctttctaaatgttttgtctatgcattgagtcctttggtgccacacaagaaccagactgtagcaaatcaaaagctaagcatcgatttctgaaatccactatgtcacttgtcccctgaggcaatgagtagggaacaccctagctgcctaggcaggggatgtgccatcactaagagaaaccagagggataaaaatctcagtgaataactggaaacagtatcctgccaattctccatcatccttcagctgcctacatggcaatggctacgtctgctttcctttcatgctttgtgccttttgaacctcttgcatcaaaagtctttaggaaaaacatcaaataattagacactgtaattgctggttgcacagggacaggaagaaagggtaaaaggggcctttggctagttacgtggggctgaaacagcatgaatggttcaaggaacagcaagtaatggaatgtggttaagatggaggaggcaagcatcccatttatgcttttaaaaagactatatttgtatatacacatacatatgtgagcaaacgtacagaaaaaggtcgagtttccacgttttattctctatgtgctcctcattgtttaaattatttccaataagaaagtatctgtgttctgtatacaaacgaaatgcagggtgcatatggaaggtcagtgccagataaaggtggacagacaggcagtaaggacaggaaagaaatgctttcattaggagtttgatctttatcatgaaactggtaatatacagacaaaatttaataatcctatttagcatcttctggttattaaatcaacatacactcattgtagggaatttggaatacaaaggtatacaaaaataaatttaaatgcctcagtaatcccccgagagagccagtgttgacattttggtatagttcctactgattttaatacatgcacataaatatttttgactatatgtgatcattttatgtaaatagtttggtgtatattttcccagaattttccaatgaaatatatatttctttaaatgagatcacactacagaaatgttcatcaacttactcttttcatttagcaatcagtatctcctggccatatgacttcatccactgatacagatcaacctcattctttctaccagacatagtatactttattaaacagggtgtaccttatataaccagtactctattcatagacatttaaagtatttccagtttcgatattataaaaatgctttaattactatcctgatatatttatgtaggcaaatatttcctaagataaaattcctagaaatgtactgttaggtcaaatagtatgcacattttaaagtcctccaaaaatgctgtagaaacaaattattctaataatcaaacatgagagtaccctttcaccaaaccttagcaacactgagtattttgtatcttttaatgtctgatggtctgactggcaacacataatacattattattttataaatattttcctcatgttgatatttatttattaccattttaattttcttttcaaagaaattttttccaattcatgtttctgagattataaaaaaaaagttcatccatgtttaattgtggacctttcattttatatttaaatatgtaatctagctgtaacttactttggtttaagaattgaagtaaggatccaggtttttttaaataaaaaatttaatgaagtataagatacatacagaaaagagcacaaggcatcattgtacagcttgatgaattttcacaaaataaccccatcccataccatacacccagaccaagaaaccaaatatgactcacaccctaaaagtccccttaattcccgcttctagtcattaccacccccaggtaaccactatcctgatttctattaccagagattagtgctgcctgtttgagtgtttggcttctttttctcagcattatgtttgtgacatacgcccatgtttttgcatgtgattatagattacatattctcatttctgtatatattccatatattgatttatttatctattctactgtctttggatatctgggttgcttccagtttgaggctattatgaatattatgaatgctatgtaccttcttatatatgtcttctggcaaatatatatactacatttgtttgtcatatacctaggagtggggaattgcgggtacagagtgtatgttcagctttagtagatactgcccagtagatactgcccaacggtcttccataatagctgtatcagtttacattcccaccaataatatatgagagtctagttgttccatgttcttgtcaacatttggtattgtccgactttttaaatttagccattctgaagcatatgtagacatacctttttgtagatttaatttgcatttctctgacaatgaatgcaattgatataacttttaacatatttgtaagccatttgaacattctctgtgtaaagtgttttttcaagctttttgtccacttttcttttgggttacttgcctttctcatattgatttgtagttatttatagtatcttctcctactctgggcttgctctttcattcccttaatagtatcttttgatgatcagaatttcttgagtttagtttaatctagtttatcaatattttcctttatagttagtccttctgtgtaatgtttaagaaatgtttggctattctaaggatatacagatattctcttatgttttcttttaagagctttattgtcttacctaatatatatagacctacaatgcagctagaattgatatttgtgaatggcttgaggaagattctttttttcccgtatggatactaaattgagtcagcactatttattgaaaagacatcctttctctactgtattttagtgtcaactttgtcataaatcaagtgatcatataaagatctctttctaaattctctaatctgttccattgggcttaaggaaacaggaatatgtcaccccaaaatatgcctctgacataaaaattactttttagcaaaaggcaattaagaagcagtaaacagagaaaaagctcaccctatcctaccttctgcctacaggcaggatataagttctccttgactagagaaaactctagactctttatcagcccatagacagcatcagaggaacctgaaaataaacctcactccattagtttcctcccatatatttaccttcccatcatttcccacccttggaaacctaaaatcttttcatttgtcctttcatttgtctacaaatgtattgctgtttgttgaagatgctatataagcctgagttctaagccattgctttgagatacttttcattaaagtttgtccctcatgatgtgtgctacacatgttaattagcttgtctgtttttatcttgttaatcttgtcttttgttacaggaatctgtctcaactaagaactcatagaggttgaggaaaaattatatttcctccccaatagggccatttgtctattttagcacagatgccacattgacttaattacaatagctttataataattctaaatatttggtgccataagttatctcagcctccttcatattcttaattattgtgatggcttaactcggcccttttcttttccatgcagattttatattcagtttgttgatatccatttaaaaagcctgctagaattttgaatggcttgtataatatacaaattaatttaaggaaagttgacatcttcacaatattgagtcatccattctatgaacatggtatatctttccatctacttaagttttcttcaatttctctcagtatgtcttcttgttttcaatgtagaaatcttacatctctgtcacatttattcctatgaattcggtgttttctgaggctattgtaaatggtattgttttttaaatttcattttctatttttattgctagtatatgtaagtataattggtttttatatattgacctggtatccagtacccctgcttaaatttacttattaattctaatagtttatctatagattcttttgggttttctatatatacagtcatgttgcctattgataatgacagttttatttcttactttccaaaccatatactttctatttctttctcttgccttgctacaatggctaggatctctaatgcaatgctaaattaaagtgatgctagcagatatctcaaggagaagactttcaacatttcaccatcaagaatgatgtttaagatatttttaggcactcattatcagattaacaaatttcctttgcttaggctttttaaaaatcataaatcaacactgaattttatcaaatccttttctacatctatgtagattgtatgtatatttttactcctttattctgttactacaaggtattatcttgatttattttcaaatgttaaactactcttgaattcctaaagtttatcccacttggttataatgtattatcttttttatgtatcactaaattcattttgattatattttgcttagtatttctgtatctatgtccaggagagtttggtctttaattttcttttcttgtaatgtctgtgtcagcttttgatataatgttttttcttgagaatgagctgggaaatgttacttttttttctattctctgaaagagtatgtaagattgatgttattatttattttaagtgtttggaagactttaccggaaaagccatctgccccagaaaatttatttgtttgtctgctgtttgatgcgaaggtctttaataatgaattaaactctttactagatatagctctattcaggttttctatttttacttgtgttagctttggtatatcaggttttttggaatttgtttatttcatctaaattgtcaagtatgttggcaaaaactgttcattatatcctcttattaagcatacatcttctcctaaaatgtctaactagttttctcaaaaccagtcattggataataaatctcttacaaaatgatatgctgtgctacctctatcatataaaaatttcatttaataagtcattcaaaaatatgtattggctcaaactatacaccaggcattattccaatgttaggaatatactattaaagaggacaacattcctgcttcatggagttttcatttaatgagaagaacagacaataaacaaaatagtaataagtgttctaaagaaccaagaaaggttagggtctggggaggtggaaaggaaaggccactttgaggagaacctgaataaggtgagggaatgagacatcaaaagatccaaagcaagaagtgtaaaggccctaaggtagacatgtatttggcatgttgtaggaagaatgaagaagccagtgtgactgtagcagagtgagtgagagagaagcagagatgattgagaaatctaggcagaagtcagattttgcagggtcctggagaccatggtaatgatttgggatattaaaaatgtcatgggaaaacactggctttgaacaagcaagtaacatgatctgacttgtgtttgaaaagactgttctaacgaatgtgtgtagaatagaccataagggggaaaaaaggaagttgagaagccacttagaagctattacaataatccaagcaagagatggtgctggcttggactatgttgggaacctacatatctacttacctcctataaggagataagaagtgctcagatccaggctgtgttttgaaggtagaatcaacaagacttgctgatggcctaaatgtgagagttataggaaagaaaagactcaagggtaacttctaggtttttggcctgggaaactgagtggacaatgctgccattttatgagcctgagattcttaggaaaggagcagatttagggtaagggggggttgggagtcaggagtttggtataggacatgttacacttcagatccgtttatacactcaagtggagaatcttggtggacaagtgaatatatgggtctgaatctcagaagaataacaaaaactggaaatataaacttaggagtcatgtgcaaacagatacatcataccacaagactgaattcattcatctaagaatagataagaagtctagggcctgagacctgggatactacagaagtggggaagagattcagagcaaagactgaggaatgtccagtgaggggaaattctcacgtgtatatcagtctgtttctgaattctttactctgctctcctgatctttctgtctgtctattcttctgtcagttttcattcttcatttcaaatgacaaaaccaattcaaactggcatatgtactaaagaaaaaccaggtaaccaggtttagtacaaatggggtcacctggatgcagtttctctccatctgtccgctatgctctcttccatggtggcttcatctttgaaccatcatcttaacctttagttccaggtaatagcaacagggctggggccccacaaccaggagaagagcgaatgctgctgggtagcaaaatccacagatgtctggcacaattcctctgccaaccccaaactggcttaattactttacttacggatacatttatcataactagttaggcttttatgttcacatcactactattctttctcagaaaatttccagctactcattcatatttattcttaaagaatctatgcttctaatctgtctccttccactctgatgagattgccctttccccaaagcaccttaaatttttatttcctacaaagcatccctcccgtgggatgcttgcttccatgctctcttcctgcccataaacttaccctccttcaatacatagatcaaatctttcctcctgcatgatatatttcccaattaccacatctggaagtgttatctctgtcctatgtatggctatagcataaatagcattatttaaatggtccagatttgtcaagtattttttcatatttgtcacaatctcccaagtaggctgtaaactcctttgggaagagactcttgttttatatttctatatattcttctcagcaacctgcacaatcctgaacacatagtttctacactaaatgcatatttttaaacaattgtctggttaagtcaccacttttatatatctcttcttttttctctaaggaatgaacagcaacagaagaaagcaatagaataatgtttgtggtttatgatgtggagtcttctctgtaggtaagtatccatcatttgggaatggttgtaagtacttaaagtatcttgggtgctgcagctttgattttaggcactacagaacatggtgagatataatgatgaataaaatggacacagtccctgtcctcacaaagctcacaaatttcttttccagtgttgtaacttcttattccattattttcatagtagtttttcttttaaaatttttctattttagtgtaataaattttctcagctttgatttatttttatttatttattttgacatagagtctcactctgtcgtccaggctggagtgcaacctccacctcccgggttcaagtgattctcatgcctcagcctcccaagtagctggaattacaggcatgtggcaccacacctggctaatttttttatttttagtagagacagggtttcaccatgctgaccaggctggtctcaaactgctgacttcaagtgatctgcctgcctcttcttcccaaagtgctgggattacaggcataagccaccacacccggccatcaacctttttttaagttaatgtttttggaattttatttaagcccttccctacgcagagatcatgaagatattctcttatattaccattcaaaatcttccatttttttgctttcatatttaacttttaaaagcccattgatatggtttggatctgtgtccctgcccaaatctcacatctaatcataatccccagtgttggaggtggagcctggtgggaggtgattggatcatggaggtggatccttcatgaatgaattatcaccatccacttggtgctgttctcctgatagtgagtgagttctcatgagatctggttgtttaaaagtgtgtagcacctcccgccattctctctctcttgctcctacttgggctctgtgacatgcctgctcctccttcaccttccgccatgattgtaagtttcctgagaccactgcagaaactgagccgatgccagcatcatgtttccagaaccatgaaccaatgaaacctctttcctttgtaaattacccagtctaaggacatccattgcaattgatttttatgcattgtgtaaagtgatagtcgaattacatatttttcatgtcatatccatgaatcccagtaccatttattggaaagtttaccctttatctgtagtgtctccttcgtaataaatccagagtctgtaaatgtaaagtagtgtttttgggctttctacttcgttctgttggactctttgtttatccttgaatcaataccatgccattgttattacaatagctttataataagacatgatatccatacagcaagtcctctgacttagttctcctttaaaatgtcttaggtattctaatttgaaataactatgatcatggatatttctcttcctctttgtggttctgtcattttcttctctatatattatttagttgttaggtacatatacatttcaaacatattttccttgtgaacataattttttatccctaataatgtttttaatcacaatctctactttatttgatacattgcttattatttgacagtatatagttttccattcctttattttcactctttctgtggtcttatgtttccaatgagtcttcctcaactagctgggatattaaataccctgcttctattccttttgtgcttattttagaaatggcagcatacattgttaatttatcagcctgaagatagtcattatctttactctccttccaggtaatataaggaccttagaatgctcttgattctttttaccccctttcttaacttatatgctattgttgtctttcatttctaaatattttagcctgtaagatattaaaattttgtttatgcttcattgttcatctatatttacattcacccacatggtgatctctttataaaatccttaattccttatagcatctcagctttttccatctgcaattgctttccttctgcataaagtacatcaattaagattgccttcagtgaggcaaagtcactaaagtggtggcaaactccacattgttctttatatgaaaatgttttcattttgccattattcttgaaaggtactttgtgcatataatcctaagttttcagctatttcagttacagatttattctactgtcttctagattccattgatgttgagaagtatgtaaaatgctctttccaaagtcatatgtctttttgttgttgttgttcctgctagaattttctctttgccttcagtgctctgcttatgaatttttggcttaataaatttgatcaattctggaaaaagctcaagcatcgtctccttgaatagttgtttctgccccattctctttcctctcctttccaattaaatgcgtgttagatcttctcactccagcttccatgtcttttagcctctctgtcacattttttgtctttttgtctccctgtgcagcatctgaataatttcttatgcctcatcattcagttattcactaatttctttttgattttgtcatatgtgctgtctaatgggaaaccactacattttaaaatttcagttttatatttttatttctagttctgtttaaccttcttaaaatctgccaagccacttttaattgttacccattccatgaaggtatttataagggtacttttatttctatgaacacaataagcataggtttttatttgtctctgtactcataatacataaagaatttgtgagtctggttttcttttattctattcattgcttctgttgtttctcgcatcacattttgtttccctgtacgctttgttatttctgactgtactgctcattgacccttgaaaattaggaagaaggtgccctcctccggagattcatctttgattctgccaggtatctgggagtggggttaggaacctggaactggttctaccttaaacttggaactaccttaaacgaagttcatagcttgaggttctcagaaattgaggtgacataaaaccatcctcaaatctgtaaaaaggggccaggcatggtagctcacacctgtaatcacaggactttgggaggctgagcagaacagatcgcttgaacccagcagttcaagaccagcctgggcaacatggcaaaaccctgtctctacaaaaaatataaaaaattagccgggcgtggtggtgtgtgcctatagtcccagctacccagaggatgaggtgagaggatcacttgaacccaggaggttgaagctgcagtgagccgtgatcgtggcattgtctgcagcctgggcgacagagcaagaccctgtctcaaaagagaaaaaaaaaaaaatctgcgaaaaggcttgtcggtcacgataacttacttttcctttttttctcttaccctgctcagtaccagggcaacctccctgctgtcccagaagggtagagagaactagttttatttctggttcacctttcccctgaataaatccagctttatatggagatggtctcctatgagactctccaccttgagcaaggcacgtactttgacaaaaacctccttgtcctgcaaggccgccaaaactaaagtctatatttattaggatcgacaaatgttctcagggcaaaaagaacttaggtgttctagtgttttagtctctcctcatctctttagtgcttttaagaaaatctaaaattttttcaatttaaaaaatatatccaacattttaatattttcagtggaattttggtccaaataacctatcctaccattatcagaaaccaaagcctacaatttcctctctccattatcactgagctgagttttcctggacaagctacagtatttgcatgagattcctcttggcaggggaggaaggcatgcctaggatactctttcagatgagctgtttttacaacccaaagactctcttcttccctgctaccacagagacagagtacttcctacaaatatggcagcctgcctatatgattctttacataaccactcttcttttgctctctgaagcgaactacatctaggagggtttcttccaccagctgtacactcagttcccaaaactattgcaagcaacagatacagctttttcatgtcagggtggacttttcatcttaaagagcatgacttttccagtactttccaagatctactatctctgggctctctcaccatttctatgctgcttcccttcatttcctcaatggcttctgcctgatctcatctacttgggacagtctttacatgtattttgaagtttatggactaaatttctctcctacttttgctgtgaatagagttttcaaggttctgttgttgttgttgttgaccttgcttttgaatgtttctaggaagacaagttgaaatgccaccaaatgaagctatgtttttacacaaagtttcaaataatcttgactcctctctctctcacacacataaccaacatctaatacattggcaaattctgtcaatgctaccttcaaaatatattcaaaacttgtccacttcttaccatctccaattctcttttagtccaagccacaactgtattttatcaggactattgcatagcctcataattagttttcctgcttcaccttagctgccctacaatctgttctccatatagaatttatttctaagacagaagctagatcatgtcacctgtgctcaaaatcttctaatagcttctcacgtcactcagaataaaatccaaagtctttaatataactgtgaggccctgcattccctccacctctcctctcccattatttgttgcattccagccacaatgtcctccttgctgttcttcacacaggtcaagcatacaattacctcagggcttttgcacttgctgaaccctctgtaggtgtattagttcattttcatgctgccgataaagacatacccgaaactgggaacaaaaagaggtttaactggacttacagttccgcatggctggggaggcctcaaaatcatggcgggaggtaaaaggcacttcttacatggcggtggcaagagaaaaatgaggaagaagcaaaagcagaaacccctgataaacccatcagatctcatgagactcactatcacgagaatagcacaggaaagactggcccccatgattcgattacctccccctgggcccctcccacaacatgtgggaattctgggagatacaattcaagttgagatttgggtggggacacagccaaaccatatcagtagggaatgctccacctctagatttcttcatggcttactttttcacttaatttacatctctgctcagatatcactttattaagaggccttccttgaacaatctctctaacataatgttctctcctatatccactcctgtctcctgaccaagttttatttttcttcttggtatttattattatctaatatattttattttttgttgttgttgttgtttagcgttatcttttcttccatcaaaatctaagctttagaagaataggaactttgtcttgttttgttcactgatatatcacaaacatctagaatagtgcctggcattatagtaagtgctcagtaaatatcacagaatgtgtgctgtggacacagaggaacccaattgcaggacatacagtagaaggagagaccaggaagcacttttctttctgctgcccatgatcttccacctccttgacacacagcttctttactcactactccattccacctttccaaggtcaccacttccagcttgagtctataaatcctccctgcctgaggctcctcagcttactgactcggtgtccaaatcccaaatctgattggtctttcttagtccaaaaacctatctagagtccaattagccattgctgggggtcaaagggaggggaatgtgagtgtgtctgtttatatgccaagtatagttaccctccccaggcttctacaaagaggaaataaatgctggggatctttaattaaaaacaaaacaagccttctctaatacatccctgacactgaagagagaatatatataacttctactaggtgcctctaactcaaatgccttcagaatcctgacaggtaagataaatgggtgaagaggccagggtggggaatatggcaaactcaggagcctatgctgcatccaaagagggcagccactgtaactaactactgccaaggggaacatggggccaatgtcaccagatattctgatggttcaagagaaggcagaaatctatattttagtgtgaaatctcccacttgttaaatgacaactaatctaattttttacaagaaaaaacactatgcagactgaagaatatacatccattgagcaaatctggctaaggaataccagggtacaacttctgttttgtaaagtcagctcaaaaacaggacatcagtaatttatcacactcaaaagcaatgtttctcaggggggttcagtgtgaagatttcattagttggagtaaccggtactctcagtcccctttcacagcacctgcccccatcttctctaccaatcctggtacaaacttccaccaacttttaaccatgagagacagaaggcttattgaaaagcatttgggctttgaaatcaagtgggtctggacaaaaaaacaaaacctcagtattacctcctaccattattcttaacctctccaaacctcagtctactcatctgcaaaatggggatgctaattcctacctagaagggttcttgggaataatgattattattaacagactaggagaggccccttcctagagaaaggcatgatacttgaaaatccgcaactgtgatacagaatgttcataataagctaatgccatctacacctctttgtggaataagtagagggtaaaaatgcatttaataaataacacaaggatggaaaatacagctctctgaagacccaggtcttcacaccaatgttgttgcttgtgaacctagtccagaatgtctaactttgtagaaactagcactaattagaattcatagacatcaattatgtgattattcaagaactctctcaactcttaaatccatttttgtatgcatattacaacacaacactgagtcaagtaaaggcatgccaattctccaatgaccaaaaaaaaattaatcctgtagttccgggagacacaattgggaaaagaaagccctgtttccaaagtgtcagctacaacgctgtttccaccagtggctggaatgcaagagtcttccatacactgatgaatgcagaaagcaattgctgcaaaaggtcatttcataaccactggaaatactgcctttctcccacccgaccctgccctgtgctttctggggaaaagtcaccctgtgaagaagccatcaggtcagaggcagaggctacaaggaacccttggctttataccacacagcacaccctagagcaagtttgtccaacctagagcccaggagagccttgaatgcagcccaacagaattcgtaaactttcttaaaacattatgagattattttgcgatttttctttttagctcatcagctatcattaatgttagcatattttatgtgtggcccaagacaattcttcttctaatgtggcccagagaagccaaaagattggataaccctgccctagagggtcatgcaacaggaaagggggcatcccaaaaggaaacatgaaaactatgctccctccaggaactgaaagaactctccacaactgataccaaaaatacatttctcctagcaaagaactctaagtagacttcttctctaccaaggaggtttaaaaagaaagaagtgtgtctctaatcactgtactttcccaccaagaagagctgagctcccccattccagatttgcctgggcctattcttatttctcaggccctcgtggctcttataatcacacatgtcgattatcggttttcctccggggaggcccaagcatcagaaaatcacttacatccttcactgccaagcctctcctattaggcaggcaatctgtaattatttatgctattttctagattttaaaaaaggaggggtgtctaagatataggtaaatatcagccagcagttgacaatcattgaagacaggcattgcgtaaacaggggttcagtattctattttctccatttttgtacatgtttaaaattttacataatgaaaaagttttaaaagggagggtcgaaggaggacacagatataacctgaaaacaaaaccaagtgttcttcaccatttactcatgtctagatgcagaaaaacctgggaagtgctcagactctctcatcaacagcctagagggttcatgcgccctcaaagtggagactgtatcttctaagcactactcaatatccttaacaaaatagcctttgaaaaattccctagaacttttcaaaagtattctggaagaacccagtttcccttcttgaccttcccttctagacctgcctctaccaattacccctacagcctcttcctcctacaacgtcctctacttcctgttccagactgctctgctgaacaacccagttattgaaatacctcctgggtggcaggcaaacacctgtgttccagcaggttgtctagctgtttcttccttctggatgtcagatgggatcagtttgtaggaatattttgtattttcttcttcttccctttaaactcaatttgctcctagtaaggttttttttttaattgcctacagtggagttttccaacttcaacactgttaagatttggggctgaataattctttgttgtgggggctgtcccatgcattacaggatgttcagccacacccatggtttctacccatttgatgccagtggcacaaacaccaccgcaacttttgacaaccaaactatctctaggtattgtcaagtgtttcctgagggacagaatcacctctggtaaagaactactagtctaaaaaatattgaaaatacaagaacaatattgtcctggccccaccccccaaaaaatgagattatacagtttttttcccacatacacaatatcttccaacttataaatttgtaaatataaatactttgtaaatgttgtatcctaagccagaagtatataaagtaacaagagtaaaattaatttaaaaccctcacaactatattttctctgtcttcatggtttcctgtgtgaatcttatttgtttcttccaaattatcctgttttccagtcaatgtggtaatcaaaatattgtgctccaagccctctttgaacgccacataatctgtgtttgaattggaaagaaaaacttccagtgactttctcagtactccccatgacatgcactggctctccagcacctatttaacaggtgtcactggacaacagaatcccctaaaaggacatctccctacaaaatcagaaaaaagcgcagccaatgcgcccccggcccaactccaaacagtcacaccccaaccccatctctgtgtaaccacaggaaggcagcatcctctcacacacaaaatgctccagccctacagctcccagttccaattctgtatttaagactcggagtcagaaagactcactggtgcaggcgccatctcactgccacctccttcacctctgagtgaaggaagaatacccgattcccaacctgaccaagaagtgcaacgggacgttaaatgagccagtgtcacaagctgcaacacccgttgggaaatactgcaatttttcttcattaggcagagggtttcccaccatatttaaatggtacactctcttcttaagaaatctgtttttggtctgcacaggtcttgcattagccacggtctacgatacagctttgggggctatgcgttcaaaactgtctctcctctccaccccactggatttcccagctccaatcaggggctctcccaagcctccatcctcttattgcccccctcccccaccattcccctgggaatgtcatcttgttcctcctctctcttgcttacggacaggcagttgctgggtgcagggattttgccttccagggtccattccttcctggacccatttcatgccactgctggtctcagcctggatcccctcatcccagattctggccacggcctcctaactggtctcccggatttggcctttctcctctaatatagctttcactctgacaattgatagtctttcaagagcacaagctagaacagccagaagccttccgtggtttcccattccctagcaccagatacaatcctgtcttctttggtgcacagtttgtgaagcacaccaaatgtttgaccctggaggtgtccaagcaggagcagaacgagcactgagtgggacaggtgcccgcatgcagagggatttatccactggatacatggtggagggagatgggaggagggagttaaactaaatgacttttaaagtttcctttcaagcctgacttcccatgattctgggaactctttggtctgccatgcaggtcctaccaccatctgacccctgaaaagtgatgcctcctgcaaagtgatgccagacagtcccctataatgctcctcacatggtcctgcacatggttaccccacctctataggatgacttcttttaattgtctttttttttaattacaaaagtaacactccttggtgcaacaaaataaaacaacactgaagtattaacatgaagtcctcaaccactgcactcccatgggtagccactggtttcagcagaatgtatgccctcctagtcctttcctatgacacacactccattcacttgacacctggtcttatgctgtgccttaggaagaaggatatttaattcttatctgcattgacttatctctccagttccctaaggtagtaaggctaattagttcatctgcttcaaatgctgttattccaccaatgaggaattgaaagggaaggagataaggtttcttgctcaaaatcacagattagctggtggcagagttaagaccagaccaagaactcctaactcaatgttggttattacactgtaaagtgctcttctcctccccaccgtgcagaatatcatattgtacagacagcaggtagaaataattgcctcttgaaagcataggggcaggatagtccagtggttaagaacttggactttgaactcaggctgcctaggttagaatctggctgtcatttacttaactatgtgacctgagtcaagcaactgggcctcaatttcatcatcccttccttataggactgttgtaaaattagtagcttaatatctgtaaacccctcaaaacagtatatatgttaataaaacatgctatcctacctctaatgtaacacccaaaatacaataaatatcttccttattaaaacataggctggcaaatcaaaaccaaatcttgttagctctgaattttgtctaaaaataaattagcatgggtgaaaactcacacaatattagtccaaaacagatttaagtgacacaagaactgtaatcattactacaggaaggaatgacctcataaagacctcatacatcagaagcattgtaacatttactgcaccaaataataaatttttaaaaaaatcttaacagcctctatcagtaattatctaagtaaagtgggctgcaaatctgttagagaactgtttttgccatgataatatttctagtaaattgctgcttctataccaaaactactggtgttgcagaaccggcaggctaatagaaagattattatagaaacactattaaaatgaatcaggtattattaaagattcaacactacaacggcgcctgattacaagagatttcaagctgtattgcttaacgagcagataaaagtgctaattaagtccactcttagaggttatccctaggcaggactgtacacttatgtagcaagaggtcttcagactaaatgaggaaccagtaatgccaacccggctggatacagccctactgggaagatagggagagaatgagaagagccaagattttctgcgcacgaaggtaacctggtaaagcagacaagtatccaaacttatttaaacctcagtgtttttcttaactgaggaacactcagttaatcagcaacacttctgattcctcctttcttgaatgaagaaaaccaaataacccaccataaactgaagaccctcaataaacggcacaatcagcgggaggcagagaaagccgtgccattattaccaaagcctcctcgagcaaccagaagacatggaatcgctctctcaccttggccaaaagcatctctccatgcaaccagagcctagagctctcagaggtttttaaagagttgccagactgaaggcatttcgttccaggatctatttagctttcccaccttgttaattaactaattagggatgggaaagcaactcaccaatacaaagtgtcaggaaaatgctaagtaaatttgtccaactggtctaaatgtcaatgctaacttaagaaagggggcaagcgcgagagactgagccgtccccagactgctgcaatccagagctcgctaacgtagagacggagagacccgggcgccctgcagcagcagcctcccggcccagagccgggatgccggcaggacttctggaagggaaacctggaccagggccaccccgggcacagggaacgcggctggcaaggcgcatcctcgccgctcagtctccgtctccccgcatctctcagacgtcaacaaacccctgaccacaaagtgaaactttcccggcccccgctgtcgcgccaggtctctgccctctgcctgggagcgcgttgcggggacaggtgtggggcccgggctgaggaggggcccccgccccaggaccggaggttgtgtaatcggcccgggaaggggggctcgggacagctccctgcgccggagctgcggaggccagacgggggaccccagctgagggggccggcgcccggaggcgttggggggatggggagggctctcgtcccgccccccgggaccgcccccgggcgcagtcgggagctgcggcgctgacacggcccggagagggcgcccgcgcgtcagaccgagcccgaggaggggggcgcgatggctcggcagccgcggccagccttacctgcgcgccgggccggggcggcgggaggcggcttgggatgccggggtggcgggcggcgggcggcagcgctggcagccacccgggccacggcatgcgaggagccgtggcgcggcggcggg

SEQ ID NO: 1747 - DNA, 6448 bp, Homo sapiens
  source 1..6448: mol_type = genomic DNA
agatgccccacagcactgctcttccagaggcaagaccaaccaagatgaggtgggtccacagctttccctcctgcctttcctctggttctttatttcagtcttttttgcatacatcggtagagatgcagaaatagaacaaagaaacgggcaaatgggctaaattatagtgaaccaaagggcttagtgtgttaaatcttctccttttctgcatccatagaagacagtgctgctgtctttcccaggagataagatttactctcaggagtgtctttttccttcaggttacatttttgactttatagggtatgtcatcagctcccgtggtaggcttcctggcatcctgagtatatttattagcagatattttcctctttaaaaatgtacaataaggaagactaatagtaacacatttgaatgacacaattaattgactagtacctgggatacacactaatacctgggatacatctaattaaggcacttagatcttataaaaataaacactttttgaaatgttgaaataataagactagaaactttttttttttttgagatggagtctcgctttgtcaccaggctgcagtgcagtggcatgatctcggctcactgcaacctccacctcccaggttcaagtgattctcctgcctcagcctcccaggtagctgggactacaggcgtgcgccactatgcccacctaatttttgtatttttagtagagacgggctttcaccatgttggccaggatgacctcgatctcttgacctcgtgatctgcctgccttggcctcccaaagtgctgggattacaggcatgagccaccgtgtctggcctagaaactattttaatagaagcaagtagtgcccgaatggttggcatttgttagtgagatggtgaactggcagacggcacctgtgggtcaatgcccatggccaccgtcctgcttttggacaccagttctcttccaggtaaccttctggcattttggggtttcagataccatttcctaaaggtgaattattataaaatactagaaatacccacgtgtttaaaattatatatttaaggaaccttttattacggaaaatatcaagaagtagaggaatagcacagtaagcccaaagttcccatctctgagttatctacattttattaccactatctttgcggtgtctgagggaggtttctctttcctggagggctcctgtattattgccaatgtactttcctgaatgcagccagaaactgagcccacccctccacctatgtgcctttctatccctctctgaagcttctgcagaattcccagcaggacagggcttgctggaagcttggtatgctcagaagctgctaaagtgtgtatgggcaggtgtgggggcaatttcttggtcctagcacttccatatatcgactttcttttctggctgctaagtgggaggagtgtgtgtgtatgcatgtgtgtgtgtgtgtgtgtacatgcatgtgtgtgtggatgcatgcatgtgctgtgaagcagggagactagctttccactcctccttgtcttctctctgcagtgccctgggagctgtcattgccctcctgctctggggacagctttttgcagtggactcaggcaatgatgtcacggatatcgcaggtcagtctttggttgggtaggagtgtgcatcccactctgaccctctcgggtctgcactctctctgagaacacccaattcccccttcttatctcgacctctgggctttcaggaccataaagaacattggggttcctgccagaaatgaggggagcttgcctttccattggcttctattcggggtggaaggagattgatgtgcagagcagctcccgctcatctgacttttcacggttcactgggaacaatttccaaatagcaaactctctggcttctctctctttgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcacatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggtgtccaggcacttggcttccagcacagcactctttcccttcctccttctcatattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattggggcctgaagggcactggctgaatccactgtcggcactgcccacagatcaggagagcctgtgcatacagagagcctgctagaaagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaaccagaggcaaagacccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgggataattgtttaaaaataatacagttcgcgagcttctattcggggtggaaggagattgatgtgcagagcagctcccgctcatctgacttttcacggttcactgggaacaatttccaaatagcaaactctctggcttctctctctttgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcacatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgagaagcagtggataaataaggctgttggagataaacttcctgaatgtgaagcaggtgggtgctgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattagggcctgaagggcactggctgaatccattgtctacatcgcccacagattaggagagcctgtgcatacagagagcctgctagagagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaacaagaggcaaaggcccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgggataattgtttaaatataatacagttcaccagccagggctcaaaaatctcagtatttcccacttcctttgttagaaaagtgggaaatagagctttttgtaatgtaaacaatttaaaaaacagaattattttaaaactgcaactattggaaatgagatcagcaggtggtaagggcaaagcatttaaatctttctactttacgcagcagtgacagccgcccatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccat

SEQ ID NO: 1748 - DNA, 6448 bp, Homo sapiens; identical to SEQ ID NO: 1747
  source 1..6448: mol_type = genomic DNA

SEQ ID NO: 1749 - DNA, 124714 bp, Homo sapiens
  source 1..124714: mol_type = genomic DNA
aggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggtagggaaggggcgggctgcggtctgctggctgctgaagtgtgccccgggcgtgtgcacccggcgtgtgcaccggcgagcgctgcgatccggctctttgcgtgtgtgttgtgcgcgcgtgtgtgtgtccgggagtgcccgcgtttctctgcgcggtggagttgtgggtgactgcggacggtggtgtgtctttcgaatggcgtgtactcgtgggcatccatgtgtgccttaggtgtgcacattttggactgcgtttgtggaattgtgtgtcggggcgcagttgctggtggggagcggtgcctggcgggtgtcgtgtgtgagcagctgtgcgcagagcggggtggcggggtgggtgtgggtggtccagccccacgcccagagccccctgtccctgctggtcggcgcagtgcgtagcttaggagcctcgaggacagctgggacccgacgggcaagggcgggcctcgcgggcaggctgggcagccctcagggaacaggtccgtgcggcccacgtgggtcgcctgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccagggacgccgagtccagctgctggcctcggcattagacaacccccagccccagcccctgccatccctgctcccttgcagccagcctcatgccgggggtgccacatgggacacctcctcctagtcccacaccttaatttaaaacatttacttttgaaacctactagtcgtaaaattgaaccgcagtgaacgagcacccagctcttaccacgactcactctctggagagttctggcgcctcggcgctggctcggacgcagcaaggccagctctaggggtcgggtggctctcggccagagcgaaggatattctttcccttcatcgccttggtgtctttctctgggggaaaaaaatcgcctttaaccaagggagccaagatctcaccagtgcaggaggctctcaaaatggagcgccggcatggggttgggctgcggaggggacagcatgggcggccttttggtatggatgcgcttcccaactgtcaggggctacgtgatggtgttcccagagaggcgggctgctttgcgggcttttaggagccagggatagaaacctggtccggttcctttggtttccctcggccgagactgaagccctgcaatcctagccatggcaggccagggggatgcgatgaactcattttctcatttttcatcctgacttagtgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaagggaaggcccgggggccctgcctctcccttgcggtgggatgtggtgccacggtggcacattctagccttgcctgctccctctgcgtcccactttcatgctgtttttaaggtggaacagaaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttccaacaagccctcctagagatagattctaagtgaaatacaagaacgtggacacactccgtcccctttctggccacagggctgtgcagaattagaagtgcagtctatggaaggacaaggactggacttcgcttggtgcaaacgccccagccaggcgccccatactcacctagcaccatttcaccctggagctgtttcctcctgttgaagcgctggtgctcacaccccctaccttcagggctctgcaagcacagttccaaggtctgcagcgcgggtacagtgcatgccctgctgagtgtgcgtcagagcagttgtctccctgtgacacttattctaagaccctttttgctactcataagtggtagagtaccacactcactcatgaaccagtgataatccagggtactaacgggggccccggagtttatttggcaccgaagattaagctacttggcagctgaatttttatctagattggggttaggtttgtattaaaattttgcattccagcaagccctaaaccgtgcttgttcattgtgggataatgcgttcaactgatgagttgccaggccaggattgatgggggattatgtgtattctgctagtttgtcagcacctgatgtcactgtgctggggggtgggggaggcatgtttggagttaggatgagcagacacttgtagattttaatcacactctactttggggctccctgctctcctatggtagcagggggtttctgtgtcgttcttatgtcctcatgtaaagctgcacatctgtgaatgtcaggtagctcttgtgcttttccccttagattgagtttctaatctgggaatgacagagggtggctgtatatggagacagcagcatgggcttaggggctcttttggtgccagttaccctacggaaaaaaggtttcttcaaatcactttctacaaagactaaaaaatggttggaatctagtggtgcagattgtaatatgacttcaggtaatcaatacggtttgacaggtggaacatttcttagatgctgatgagcagggcgcaagtctcaagatttttaaatcatctgaaaagcacagtaaatcctttaaagagccctaccttggccatgttgtttcaagtaaaattgaatttcagaggcaaagcttcacatcggaggcatgacgaactaaagaaatccttcccagagacctccactctcttcctgttgccaccctcctctgccagcagcagggcaggaaagatgacttcttggggctgtgtgcctttaccttaagaagcaagtgcaccctgaatgcttctaatcccgcagctgggttgtctgggtatttggatctttttggtgcttgaggtactacccaagttggcaggaagccaggagcctgggggtggaggtgtcttagccccacctgtggcatgagacaagaggtcttctccagcaagggatgggtctctgacccttggctaagaaaactcaggattgttaaatacgtactgcatggataaggttgctgtgaccctgaaaaaaggaagaaggcttttgggtggtgcgtggttctcctcttggaagtcttcccagatttcgcctcagtactctcttgccctagcttaaatctttccttgctctgtgtccccttaggcaagtgaggtctcctctcaggtaggcatgatattaagtgcatgtctagaggacagttccttctacctgcccaggtgcactggctgaactcacctatgcccacatctgtgcattggcaggtgatatagatatacacctgagctgtccccctgagctgcagacctaacactaggtgtgggctccgagctgttccacatcaaaacagagccgaggacacatctccctcactgaagctgtgtctcctacctattatggtcaacacgtctcatctactcatttgttaaagctagaaatctctggagagttttggagctctttctctgtcttcacttgaaatctctggagagttttggagctctttgtctgtcttcactttgccatctaattgggtcagccctctctgagggctcacacccactcttccggcacagcggagccttatctgcccttggcccagagaatgcttccagttccttcactccagccacaccggcagcacttcccagtttaaaacgcagatttcatcatcccactgtcttctgcctccccaaccccaccaaaccttggtttgttctcttaacgcagtaagtgcttctgatacctactgtgtgccttggaccaagctggagtctgagaaggttgggcccaggcatcctccctacctgtgcagagtttaaggtcttgggctgggggttgtatgtggggtacctatcaaataagaccagggagcgtgaagtgctatggaggggagctcctaccccagtatagggggctccctggagaagcaccctctaagctgatacctgggagagttgggggtgcaggggaggggttggagttggggctggattgttcgatgcctttcttctgtctcacccagacttccttatctgctaaactcctactcatttttgttttaattaataccaagatagaatttatctctcataaagcatgcccattctaagtgtacagtttaatgattttcagtaaattaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgagctgggtgcttggccatcccgctgctagatggcgagctctcttacctgcctctcctgcctgcacctggctcagcactggcacctacagaatacccaaggtgtgttggctggaccagctgaagttgtgttcctcacatttcttttgtataactcctgagtatctagcagagtgtggggatttaaaatacagcgcatgtattgatgtgtcaggtgatgtgagccctgctacatacataccttaacttgtttcatcaagaacttgtgaggcaaatggcaaatcaaaaacaaaaacaaacaaaacaaaacaaaacaaatctattttctaagccaggcacagtggctcttgtctgtagttccagctactagggggtgctgaggtgggaggattgcttgaaatcagggatttgagcctgggcaatattgtgagaccctgcttcttaacaaactttttttttttgagatagggtcttgctctgttgcccaggctggagtgcagtgatgtgatcccagctcactgcagccttgaactcctgggcccaagcaatccccctgccatagtctcctgagtagctaggactacaggtacacaccaccatgcctgctgatttttaaattttttgtggagacgaggtcttgctatgttgcccagactggtcttgagctcccgggctcaaataatcctccagccttggcctctcaaagtgctggaattataagtgtgaactactgtgcctcagcccaagccatttttctaaatgaaaaaactgaggaggcccagagcaaataagtagcccaagggcatcagcagaaagtagaaggatcaagaattaaacgaggtcactttctcttccgcccttgttttggtagtaatgatatgcccttttatggccttgcctgggctggtgttcagattttcctgtacgagtcttgtcatcccttcctaagccatggaagctccttctagggcatgagtgctgtgtgacacatgttcacacagtgttgccccagtacctacctagtccacaactgaacaggtagagatggttcaagcaatgtgtgtgtgtagagaggtctcctggtaaatagaaggggctgggggagggcgttgaatgcagtggtgctgtggccttgggtggcttggtgcatttctgatgcatttctcaccttggatcattttcactctttgaggaagagagcagaggatgagatgccatttgacagatgcacaaaccaagacacagaaattgtatacccattgtacgccaggtagatcacaaatgaccgttctctcccatggttgtagagaactctcatggtggacagaaaccatgaaagaaatcatggtggaaagaaccaagacattcttgaatcggagtattagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattgatgacagccccaactcctccctttcactcccatcttttctatttgctgccctgtaatcaatttttggagagaagtgagaacctctcgaaatcgatcacctatgttgaaaaaaaatcatttttaacatcatgcagttttccgtatttactgtgtgtggctggagacactcctggcagaatgagtgtgggatgtaggaggtccagaaaagcccccagcttcaggggctgagatagggccatgggtggcagaactggttgtccccccgccccccaatccctcagcagtggttgaggtgtgctttattagaaactcttcagtcatgcagtttggagcccgtgctggtgatgcagcctggatgcctggcaggggcttagcctccaggggtgggacatgagatgtggctgccgtggcttctctgtgtctttcttcccagcgagtaaaggtagacgcagggctctggcaggtgctaaggccctgcttgccttcatgctggaatgctggcaggtacaatttattcttatttcttaggaggtgctttcccctcttctttctgaagacatccagggataaagaattgctgcttttatgagcacatgttcttggtgatatgctgttaccttatctaaaaacaatacggcctggctgattattctcagagctcattgtaaggtgaaaggttatgcatttgagaattattttcacagtgtggatgggagtggggggagaagatgtagagcacaggtaaggaattccaggttttggggccagggatcgccaagcagtgtaaagggctcactgtggcctgtagctccttccccctgtggtttgtgctgggccagttgctggctccccaaaaccattatcaccattatcattatcactatcatatccatcacctcaccatcattatcactgacatcatcacttttctccatcaccatcatcatcatcatcactatcatccccatccccatcatcatcattaccatcatcattgctgtcgctatcatcatcatcattccattcatcaccattcatcatcactgtcatcatcaccatcatcatcactgtcatcaccatcaccaccaccatcatcaccatcgccatcatcactgttatcgtcaccattcatcatcactgtcatcatcatcgtcatcactatcatccccaccatcaccaccatcattatcaccattctccatcaccatcatcactatcatcctcaccatcatcaccattctccatcaccatcatcatcatcactatcatccccaccatcatcaccatcaccatcatcatcactgtcatcatcaacatccatcatcactgtcatcaccatcatcatcactatcattaccatcaccatcaccaccattatcactgtcatcatcacctttctccatcaccatcatcatcatcatcatatcatcatcatcatcatcatatcatcctcatccccatcatcatcaccatcaccaccgtcattgctgtcatcatcaccattcaccatcaatgtcgtcatcaccatcatcatcactatcatcattatcaccatcatcaccatcaccatcatcattactgtcatcatcaccattcaccgtcactatcatcactgtcattatcaccatcatcatcaccaccaccatcaccatcatcactgtcatccccatcctcatcatcatcaccatcactgtcatcatcatcaccatcaccaccattgccatcaccatcaccatcattatcactgtcatcatcacctttctccatcaccatcatcatcatcatcatcactatcatccccatccccatcatcatcaccatcaccaccatcattgctgtcatcaccattcaccatcactgtcatcatcaccatcatcgtcattatcatcattgtcaccatcgtcaccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacaccttgcctgagggctggctttgcaggtctgagtggctaggtcagggcactgctagtgttttctatgtttgtagtcaattggtgagagtttgttttacgcatttgttaaaactgtgggacagtggtctggaagccaacaaggctttagggttggcagagtgactcccatcccatcattgatgtctggctttgacttggcatgggagacattgcctctccagatctcagttctctcgtttgacaaatggggcttagggttgaacagcctctaagtcctctgtcagctctgcaattcaggaaagatgtttaaaaatgcatacttgcattgtaggtacatccaacatagagcaaagagagaattttcctagctaaattgactgcaaaaaaatgaaacctcttgggccgggcgtggtggctcatgcctgtaatcccagcactttgggaggctgaggcgggcaaattacgaagtcaggagttcaagaccagcctggccaacatggtgaaaccccgtctctactaaaagtataaaaattagctgggcttggtggcgggcgcctgtaatcccagctactcgggaggctgaggcaggagaattgcttcaacccaggaggcagaggttgcaatgagctgagagatctgagccactacactccagcctgggtgacagagcaagactccgtctcagggaaaaaaaaaaaaaaagaatcctcttataatatgcaggcatcttagcaactgccatcttagcaactgccatcttaagaggcagcattatgattcagaagaaactgataacattgaggaatacatttgtggagcacagattaggagagattggtgcaggggtggggggtggcaggaagatattaaggttggaatttagggaggtgagctctgtgggttggtttcatgcatccagctcaccattcaacctttcctgttaacttcctatattaaggaggctgagattaagaagacagggactcgtggcgtaagggcgagacagacatagaggtgagtgactgcagtgggatattcactgtgggagcattgaaggttggcagtcagctagattcttaggctgtagatcgggggccttatttagaagctgtttactgttcccttaagaggatcctctagcaggaaaaaccactgctagggttgttgctttcctcattataatgatgtctttatgttcgtcttaggaggtgatagtactgattatttaagaaactggtcagccaaacttcttaactaattgtgaattagagaaaagtcagaagtagggagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggctcacgcctgtaatcccagcactttgggaggccgaggcgggcggatcatgaagtcaggagatcgagaccatcctggccaacacggtgaaaccccgtctctactaaaaatacaaaaaaaattagccgggcgtggtggcgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacaggaaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcaggaggtcgagaccagcctggccaacatggtgaaaccccatctctactaaaaatacaaatattagctgggcatggtggctcacgcctgtagtgccagctactcgggaggctgacacatgagaatttcttgaacccaggaggtggaggttgcactgacccgagatcaggccactgcactccagcctgggcaacagagtgagacttgctctcaaaaaaaaacaacatccagagtcttccaggaaatttaccgtttcagtgtggcatagtgtagagtttgtttattatctagaatatggtttttcttttttgtgttcttgaacttgggcgttcacttcgtttgttgacctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggcggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaagattaattccagggtgaacaaaggagagggatgctggggccgggctgcctccccaggcaaatcacatcactgtaaaatccgagaaaccagaagttgcctttgctactcactcagtggctgcttgctgtttcttggattagatattgaaagaatcccatctttatagtctactgttcatatttatggtctggagaagaaaatgtaattttcagcaaaattctatcacgtctggtaaataatttcaggatctttacctatgataccacattaaaaaaaattcgtatggcttcagcattcagaaattgttcttttcaaactctgggccctcgggttattacaagatttaacaccgaggcaggaagcctgctcgcctatcactggagacaggtaggttgctatggagaccaggtgtgtgtccctgcggtttcctgggtatcccagttgtcctggaaaagaaatcagctcactttatgtgatatttctgcaatagtgtgtgtgaattaagtttttctaaacacagatcagatgtttttgttgacttacagtgtgatttctgacataattttgtcctcggttttgttttgcttaattatgaatcctacataaccctaccttttcctatcagaagcacttccatgcatcaagaccccctatccaaaacagccacaacaacttcaccaacaaaatctcttaaagctagagatgcctgctttggtgtgaatgatgattaccccttaaaataattcaacaattttttttttttttttttgagacagggtctcagtctgcctctcaggctggagtgcagtggcgtgatctcggttcactgcatcctgtgcctcctgggttcgagcaattctcctgcctcaacctcctgagtatctgggagtaccgggatgcaccaccatgcctggctaatttttgtatttttagcagagacggggtttcaccaggttggctaggctagtctcaaactcctgacctcaggtgatccacccaccttggcttcccaaagtgctgggattacaggtgtaaaccaccatgctcggcctcaacaattattatatatggtttgccagatcctggcctgggcactggggatgcaagatagagcaagaccattggaggccctgccctggcggagcttgtattagggttgtgatcctagaccacatgaagcccacaagggggccctgggctcacccgttcctggctcacattcactgtcagccacagctaaacctcggggcctggaacctctcttgttgtccccatgggacgagtgggcacatgccttgttggatggacaataacatcatctgtttttgtttgatgtgttattattcagaggcatttttcagaatggagaacagtgccttatcagtctgcttctgataattttatacatgaaaaaaatcctatttgtgcatattcttgggtctctccccatttctaaaggcagtcaacttggtggttggctgtaaaaagctctttacacttcctaggacttgtcaaatattgacaagtctttctcctttcatccagttcagcaccagcatcctcaaactcactgaaacagagcatcccacagtggcagccactgtaggccccaggtgggtatcctactcctccacccccgccccagactcccccaaccccagctcgcacctgcagaagttacgtctttgcagttatttcaggagaaaaaggcggccactctttctctcccttctttgggtttgtgttcagcaagggtctactgcagtcccggtgccggacagcctgttttgcccatgcttgttaactgatggggtcctcaagtggccttgtgacaggcctgataaggccgcacgtgggtgtggttagagttgatgaccgctccggacattggcgatgtgaggaaagtgacagactccagcctccatgtgcagccggtgattggccgggtgggctcggttttctagtggcaaaggatgctgtgatctgaataagaaaacaaacctcaggccccaagtgccacgggcttagagacttgagaggaggtgcttgcaactccatctgggaggctaagggcagccaagagctgctgtcttgaggctgacccactcccttgcagtgtaatgggtagtgaacaggccatcctttttaaaggaaaataagtgcctccctatggactctgttcctatcctgctaccctccctgaagcttgaatagcacccacccgtgccttctccatgccagcccttgggtctgccgggaccactgccatgcttttgatggacacggccttgtagcgtctatatcctcatctgtgaaatgggaattccacagcctccctttcgcaggctgcttgtaatagttgccattaaacctcttctgaactctaaagtgctgtatcaatgtaaggaccatcatcaacatcattgtcgtcctcatcgtgagtctttccaaattcacctcctgctgccccagcacgggagtgtctgagactgcaggtttccttgatgggttcctggggcttcccttgtggaaatttgagttctgagccttctgcacttttccatcccccagtctggagtcaacctgtatttttcattttccctctgcaagatgtcagcccataggagaggcctggaggcttgcaggggaaatgggacgatgtttgaaggaagcccccgtgcctgtgggagcatgcagcctcctccgtctttttgtctgccaggcaggggagtaatttgccgttatgtactgggcagtctgggagctggactctcagatgaaaaatgcttgttcaagcacagacagccaggcatggctcaaatcagagcatcgatttagcaagcagctctgctcaaacagccagctgtgtgatcaccttttcaggggatgataggctgacgggcaggtggggtggggtggggtggggtggggtgggcagactaatacagggaccctgtgtttgggagcctctgtttaagcagagaccgggcctggagagagtatccctgggtagggaaaggtgctctcacattagtgggttccacctggccccttggtggagctcccattcattcattcactcattcactcattcattcacatcgtgtctactatgtgccagtctctgtgctaagagagtgatccaagcagaaggtctgaaatcctcagggattcgtttcccagccgacttatgccttactaagtggagcaggttctgggctgcaggggactgacttgctgctgcaggtctgggtcttgaactaagggagaaagacaatgcccatcttcttcttggcgcagtcatttgaggagaggagcatttgcttcttgccaacctgcctgcctgggaggccctcttgctcctgcagccccccgagtcccctttgcagctcccagtcttgcttggggttgcctcctccaagaagcctcctgggctagctcaggcatcctgtggaggcactgctgggccactgatgcctgagctcctgtggcctggctgtctgcagggcttcagtcctggcctttcacttcccagacatgagtcttatctttccacttggttagggcctccccacggacatggacggatatggtttggatttgtgtccccacccaaatctcgtgttgaattgtaatctccagtgttggaggaggagcctggtggggggtgattggatcatgggagcagagttcctcttgctgttctcatgatagtgagtgagttctcacgagatctggttgtttgaaagtgtgaagcacctccccctgctctcccttctgctccagccatgtaggacgtgcctgctgtcccttctgacgtgattgtaggtttcccgaggcctccccagccatgcttcctgtgcagtatgtggaaccgtgagccaattaaacctcttttctttataaattacccagtctcaggtagttctttatagcagtgcgagaactgacagggaccgtgtgtttgggagcctctgtttaagcagagaccgggcctggagagagaatccctggggagggaaagctgctctcacatcagtgggctccacctggcaccttggtggggctcccattcattcattcattcactcactcattcattcacatagtacctagtatatgtgccagtctctgtgctaagagaatgatctaggcagaagacctgcccgctcagggcttctgtttctagctgggagcaacaacagtaaactaaataagcagattatattgtataatatagtaatacttagaaggtgatgagactgtggaaaacaatacattagtgaagagggtgagggtattggatggaagagcgtgagtgtattaggccgttccacattgttataaagaaatacctgagacacggtcattaataaagaaaagagatttaattgtctcacggttcttcaggctgtacaggaagcatggtgctggcatctgctcaacttctaaggtggccttgagaagctacaatcatggcggaaggtgacgggggagcaggcacgtcacatggagaaagcagaagcaagagagagaaaaatgcaaggtgccacacacttttaaacaaccagatcttgtgagaactcactatctcgaggacagaaccaaggggatggtgagaaaccattcatgagaaatccacccacatgatccagtcgtctcccaccaggcctcatccccaactctggggattacaattcaacatgagatttggttgagacatccaagccgtatcagtgagagatgcagtttttttttttcaggggaaagtgttgttgttgttgttgttttaataagatataatttacataccatataccatgaaagtcgccatttaaaaatgtacaattcagttgcttttagtatactggcaaagttgagcaccagtagctactaatttcagaacattttcatcaccccagaaaaaaatctcatagccattagcagtcactcctcaatctcctcgtgccctaggccctggaaaccaataatttactttaggtgtctctggatttgccacttctggacattttatatcaaggaaatcatgcaatatgaggccttttgcatctggcttcctttaccaagcacagtgttttcatgcaccgccaatgctgcgtgtgtatctgtactgcatgcctgtagatggcggaataatattccaatgtatggatagaccacattttgtttatccattcatctgttgatgaacatttgggctgttttcacttttggctattctgaacaatgctgcgaggaacaagttttttttgtacaagcgtgcaagttttttgtggatgtatgttttcatttctcttaggcaaatagagagacacaattttactttttatttattttattttttatttttttagagacaaggtcttgctctgttgcccaggctgaagtgcagtggcgccatcatagctcactgtagcctgcaactctatggattacatgttcctcctgcctcagcctcttgagttgctgggactacaggcataccccatcattcctggataatttttaaatgtttagtagagatgagttctcactagattgcccaaattcgtcttgaactcctgggcttaagtgatcctcccaagttagccttataaagtgctgggattagaggcatgaaccactgcacccagccacagttttaaatagggtggtcagagaaggtctcatgagaaggtgacatctgagcaaagacttgaagaaaataagggcagaagccacacgaaaaccccagcaggacagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagacagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccaggctgaccctgaggtccaccatgactgtgctgcagccaccaccactggccgcttcatggcatgtttccagcacaactctctgacctggctcccccggttccccagacgcgttccccacggagtcccagcgtgtatgcatggggtcacggtgctccacgctctcaaccgttggttgcaggttcccgtccagcctctcaagctggctgctcccctttctcagttgtcccctgtgcctcttgtaccctaacttcagtgttagagcacctttcagggggaatggcgtaaaaaagccttcctttccagtagacagagtgccctggccagcagaggccaaacacattcccattcagctttgtttcatgctggatctggccccaggcctgcacctggccctggcagtgggcgcacgttaggtgggattgctgaagacaatgggtgactgaggcagttacaggtgtcagccccagatgaggctccccaacctgtaccctttaccctggagctggccccatctctcacagcccagtggtgtactaccttaggtaagcaccagttgcgcctcactctaatgaaaataataaaagctcaaatgaccagcactgtcctactgctttatacgcatgacctcaggtaatgagaattagcccacatccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggggttgttattggtttttacattttgtttgcaatattgggtttgctggtttttgtgttttttttttttttttttttttttgagacagagtctcgctctgtcacccaggctggagtgcagtggcatgatcttggctcactgcaatctccacctcccaggttcaagtgattctcctgcctcagcctcccgagtagctgggattgcaggcctgcaccaccacgcccagcaattttttttttttttttgtatttttagtagagacagggtttctccatgttggccaggctggtgttgaactcctgacctcaagtgatccacccaccttggcctcccaaactgttgggattacaggcgtgagccactgtgcccagccgggttgctgttttagttggtttttgattttagagagagggtctcgctctgtggcccaggctggagcacactggtgccgtcggagcacactggtgccgtcatagctcactgcagccttggccccctgggctcaggcgatcctcccgacatcgtaattacatttttgcagggttttcagttcacaggtgtgctctcccacatccccatttaagtttacttatttttcagccccagcctctgaggctatcattattttacagacgagaacaccgggactcagagggtgatttgtccctagtctcagggctccaaggcggcagtgccagcgttggtgggggtccccagtgccaggccagggtggcactgttctccctgtgcctctctgcttgtccccactgcctgcttctgcagaggcctgctcagagcaggtttccagcaaccttcctcgccagcatcctgctaagcaggccctggagggcggtttccctgcttccccacaccgggccagagctgccttgatatttatttcagggcatccctgcagagggaactgctaatgcagtcatggctttaagacgtcacaagccacagctgcaggtgcttcatcttaaacatctgccttcctggctgggagaagcccgggagcacctgctgcaggtgtctttgcacctcggtcctgctggtcccaggcccagctgcggccaattagcacctctgttgggcaccatggccatttccttgctgcatgggagccgctggcctttttccactgtgttgggggaaagttgttgggaaatgaggaagcagttggggatttaaaaactctatgcaggaaataggctgttgggttaacatttaagccactgaacagtcatggagtgtttgcttggaagtgaggcccacgaggctgcagagggccatgagattcaaggatggtgttcgtcaggcctgtccgtcatcctctctgggttcgacaccatctcagggtactcatgcctgttaggtgcttggtgaacaaaggcatcccagacagaatcaacccagaaggaagaggggtgggtggtaaacgttcgttaacttagccatgttctcttagggtttcttctcaaaataagggcagatgggagatctccctgcctcaaggggtccctggccaaggggctacaggcagatattgcccagtcagccccagtgaggtgacagaaggcgggaggtggcttcagtgtgtttgaaggaggctggcatcacaggttctaaagcagatggcaggagccctgtggctgggcctgcttcagaaccttggctggctgctccttggaggtgaggtgggggcaggcagtgttggctggagacttgtggggggaattggccgcctggggtgcgtgctggcctgcctgccttccgcttccgtgccatgagccccttgttctcagctgtgaaggtaggtgaggctgccctgcaccagccagcagactgggttaaggtgggaatcaaaggagaggaggtgttcagctggctggagacctgctgagccccttgcatgaggagggatttctgtccagcgcccctggtcctcaagctcctcctcagcagcgttcatgagcacagggtgtgggtgtgactggtccctttgggcagaatctgagagtgcccccttctccctccctgtgcatttgaaagttggctggtgctcgctgacagatgccgaggctcccgtttggcagctggccatggcagccgcttgtcctccactctccctagatttggctgagctgggcccctgctgtgccccacatgccccggctctttgtctcggttgtccctttggctcagctctgggtgtcggctcctcggaagcccttcgtcacccaaccagagtgaactccttctcccaggtggccagagcatgttgaagtgaccctgactttcttctgtgggtcctacattttagcggggagtacaagtgcctcttcactgcagcatctcctaaggaagtgagcctgtggggaggtctctgatgctactgggaatccagcttcaccttcccccaactcctgggatttgcagccacagctaagagtgggagaactttgccttgtttgcattgctccagatcgtgttaaacagaatttcaaaacatgcattttgtaggtagtagttctgtcatccagaatgtgtaaagtaactctctaggtagctgttatggatggcctgcaggaaggatcataccagtgacttcttttgagccccctgccgagtggctagcgtcaggtgggggattagactctggttctttgcttcctggccctgtgagccccaggcaagtcagttaacttcttggagcctcagtttcctgacatgcaaatcatactgacctggtaaggctattgtcaggattatatgagctattatatcctaaagtatattatatcatactttatagagcgtagtatatattcaactaactgcatttgtgttagttcctttattttgttaacatggggatcaatggctttttttttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgatttatggttagccccggatccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgagctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaagatcactagtggtgagcctttaaatgcctgtaagctgtccgaggggttcttcctaaattaaattaaatttttaattttaattacttaatttttttgagatgggatcttgccgtgttgcccaggctagtctccaactcctgggttcaagtgtcctcctgcctcggcctcccaaagtgctaggattacagatgtgagccgccactgttggtctctaggggttcttatgcacctagaatttagagactcattgctccaagcttcattgaatctttcctgaacagtcttgtgataggcgggataactcccacccctcagatgctcacatccgaatccctgggacctgcggatatgttgccttatacggtaaagggctttgctatgtgatgaagattgaggaccttgaggtggggacagtatcctggattaccagggtgtagtcactgtattcatgtaagtccataaaagtaaggaacctgtcccagctgcagtgagcccgagggaggtgtgactctggaagaagacgcagagatgaaacactgctggctctgctgacaggaatggctttgagccagagtgtggtggcctacagaggctggaaaaggcaagggaacagatccacccttaggtcccccagaggaaccagccctactgacacagtctccgtgggacctgtgtccacagacagaactgtatgaaaacacgattgtggtgtgtaagccactaggttgatttgttacagcagtgacaccgggctttgtctctgcttttgacttttcctccagtgtgatcccttcccctgcttctgacccgtggatcccagccctgcccaggcccagatcctgggctccaggtgggcctgggttggggctcccagctgcaggaatgcaaagttcatggttctacaaagtgctttgaggtgacgttggtcacatcagctcggcctcagatttgctgctttttttctaaagaagagacagctccaggccctgcctgactgacctagttggggatgcaggccgaggccatatcgagcagggtaagtttccaagaatctggctttaggattagtcgggccacacggaaggagttcctggtctcgtgacacctgcacaaatggtcttcaaccctcaaaacacttcctgttatttaaatcttggtcctttgattttttttttttttccttttagagactatgcacaatttatgtggcaagctagagatgctttctttttcagagcggcctttatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccgtgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccgtcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttcgggaggctgaggcaggaggaggcttgaggcctggaattcaagaccagcctgggcaacatagcaagaccctgttttgttttgttttgttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgatggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaactgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaggaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggcttgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaacttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcatgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaagatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacaggtgtgaaagcccttcttatgttatcagtattaccctaatatatcagagggctaggatttctcataaggcgactgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcctgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaatgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatgctgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggggtgctgggcagacgtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcacgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgttgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1750 - DNA, 123918 bp, Homo sapiens
  source 1..123918: mol_type = genomic DNA
agcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccagggacgccgagtccagctgctggcctcggcattagacaacccccagccccagcccctgccatccctgctcccttgcagccagcctcatgccgggggtgccacatgggacacctcctcctagtcccacaccttaatttaaaacatttacttttgaaacctactagtcgtaaaattgaaccgcagtgaacgagcacccagctcttaccacgactcactctctggagagttctggcgcctcggcgctggctcggacgcagcaaggccagctctaggggtcgggtggctctcggccagagcgaaggatattctttcccttcatcgccttggtgtctttctctgggggaaaaaaatcgcctttaaccaagggagccaagatctcaccagtgcaggaggctctcaaaatggagcgccggcatggggttgggctgcggaggggacagcatgggcggccttttggtatggatgcgcttcccaactgtcaggggctacgtgatggtgttcccagagaggcgggctgctttgcgggcttttaggagccagggatagaaacctggtccggttcctttggtttccctcggccgagactgaagccctgcaatcctagccatggcaggccagggggatgcgatgaactcattttctcatttttcatcctgacttagtgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaagggaaggcccgggggccctgcctctcccttgcggtgggatgtggtgccacggtggcacattctagccttgcctgctccctctgcgtcccactttcatgctgtttttaaggtggaacagaaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttccaacaagccctcctagagatagattctaagtgaaatacaagaacgtggacacactccgtcccctttctggccacagggctgtgcagaattagaagtgcagtctatggaaggacaaggactggacttcgcttggtgcaaacgccccagccaggcgccccatactcacctagcaccatttcaccctggagctgtttcctcctgttgaagcgctggtgctcacaccccctaccttcagggctctgcaagcacagttccaaggtctgcagcgcgggtacagtgcatgccctgctgagtgtgcgtcagagcagttgtctccctgtgacacttattctaagaccctttttgctactcataagtggtagagtaccacactcactcatgaaccagtgataatccagggtactaacgggggccccggagtttatttggcaccgaagattaagctacttggcagctgaatttttatctagattggggttaggtttgtattaaaattttgcattccagcaagccctaaaccgtgcttgttcattgtgggataatgcgttcaactgatgagttgccaggccaggattgatgggggattatgtgtattctgctagtttgtcagcacctgatgtcactgtgctggggggtgggggaggcatgtttggagttaggatgagcagacacttgtagattttaatcacactctactttggggctccctgctctcctatggtagcagggggtttctgtgtcgttcttatgtcctcatgtaaagctgcacatctgtgaatgtcaggtagctcttgtgcttttccccttagattgagtttctaatctgggaatgacagagggtggctgtatatggagacagcagcatgggcttaggggctcttttggtgccagttaccctacggaaaaaaggtttcttcaaatcactttctacaaagactaaaaaatggttggaatctagtggtgcagattgtaatatgacttcaggtaatcaatacggtttgacaggtggaacatttcttagatgctgatgagcagggcgcaagtctcaagatttttaaatcatctgaaaagcacagtaaatcctttaaagagccctaccttggccatgttgtttcaagtaaaattgaatttcagaggcaaagcttcacatcggaggcatgacgaactaaagaaatccttcccagagacctccactctcttcctgttgccaccctcctctgccagcagcagggcaggaaagatgacttcttggggctgtgtgcctttaccttaagaagcaagtgcaccctgaatgcttctaatcccgcagctgggttgtctgggtatttggatctttttggtgcttgaggtactacccaagttggcaggaagccaggagcctgggggtggaggtgtcttagccccacctgtggcatgagacaagaggtcttctccagcaagggatgggtctctgacccttggctaagaaaactcaggattgttaaatacgtactgcatggataaggttgctgtgaccctgaaaaaaggaagaaggcttttgggtggtgcgtggttctcctcttggaagtcttcccagatttcgcctcagtactctcttgccctagcttaaatctttccttgctctgtgtccccttaggcaagtgaggtctcctctcaggtaggcatgatattaagtgcatgtctagaggacagttccttctacctgcccaggtgcactggctgaactcacctatgcccacatctgtgcattggcaggtgatatagatatacacctgagctgtccccctgagctgcagacctaacactaggtgtgggctccgagctgttccacatcaaaacagagccgaggacacatctccctcactgaagctgtgtctcctacctattatggtcaacacgtctcatctactcatttgttaaagctagaaatctctggagagttttggagctctttctctgtcttcacttgaaatctctggagagttttggagctctttgtctgtcttcactttgccatctaattgggtcagccctctctgagggctcacacccactcttccggcacagcggagccttatctgcccttggcccagagaatgcttccagttccttcactccagccacaccggcagcacttcccagtttaaaacgcagatttcatcatcccactgtcttctgcctccccaaccccaccaaaccttggtttgttctcttaacgcagtaagtgcttctgatacctactgtgtgccttggaccaagctggagtctgagaaggttgggcccaggcatcctccctacctgtgcagagtttaaggtcttgggctgggggttgtatgtggggtacctatcaaataagaccagggagcgtgaagtgctatggaggggagctcctaccccagtatagggggctccctggagaagcaccctctaagctgatacctgggagagttgggggtgcaggggaggggttggagttggggctggattgttcgatgcctttcttctgtctcacccagacttccttatctgctaaactcctactcatttttgttttaattaataccaagatagaatttatctctcataaagcatgcccattctaagtgtacagtttaatgattttcagtaaattaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgagctgggtgcttggccatcccgctgctagatggcgagctctcttacctgcctctcctgcctgcacctggctcagcactggcacctacagaatacccaaggtgtgttggctggaccagctgaagttgtgttcctcacatttcttttgtataactcctgagtatctagcagagtgtggggatttaaaatacagcgcatgtattgatgtgtcaggtgatgtgagccctgctacatacataccttaacttgtttcatcaagaacttgtgaggcaaatggcaaatcaaaaacaaaaacaaacaaaacaaaacaaaacaaatctattttctaagccaggcacagtggctcttgtctgtagttccagctactagggggtgctgaggtgggaggattgcttgaaatcagggatttgagcctgggcaatattgtgagaccctgcttcttaacaaactttttttttttgagatagggtcttgctctgttgcccaggctggagtgcagtgatgtgatcccagctcactgcagccttgaactcctgggcccaagcaatccccctgccatagtctcctgagtagctaggactacaggtacacaccaccatgcctgctgatttttaaattttttgtggagacgaggtcttgctatgttgcccagactggtcttgagctcccgggctcaaataatcctccagccttggcctctcaaagtgctggaattataagtgtgaactactgtgcctcagcccaagccatttttctaaatgaaaaaactgaggaggcccagagcaaataagtagcccaagggcatcagcagaaagtagaaggatcaagaattaaacgaggtcactttctcttccgcccttgttttggtagtaatgatatgcccttttatggccttgcctgggctggtgttcagattttcctgtacgagtcttgtcatcccttcctaagccatggaagctccttctagggcatgagtgctgtgtgacacatgttcacacagtgttgccccagtacctacctagtccacaactgaacaggtagagatggttcaagcaatgtgtgtgtgtagagaggtctcctggtaaatagaaggggctgggggagggcgttgaatgcagtggtgctgtggccttgggtggcttggtgcatttctgatgcatttctcaccttggatcattttcactctttgaggaagagagcagaggatgagatgccatttgacagatgcacaaaccaagacacagaaattgtatacccattgtacgccaggtagatcacaaatgaccgttctctcccatggttgtagagaactctcatggtggacagaaaccatgaaagaaatcatggtggaaagaaccaagacattcttgaatcggagtattagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattgatgacagccccaactcctccctttcactcccatcttttctatttgctgccctgtaatcaatttttggagagaagtgagaacctctcgaaatcgatcacctatgttgaaaaaaaatcatttttaacatcatgcagttttccgtatttactgtgtgtggctggagacactcctggcagaatgagtgtgggatgtaggaggtccagaaaagcccccagcttcaggggctgagatagggccatgggtggcagaactggttgtccccccgccccccaatccctcagcagtggttgaggtgtgctttattagaaactcttcagtcatgcagtttggagcccgtgctggtgatgcagcctggatgcctggcaggggcttagcctccaggggtgggacatgagatgtggctgccgtggcttctctgtgtctttcttcccagcgagtaaaggtagacgcagggctctggcaggtgctaaggccctgcttgccttcatgctggaatgctggcaggtacaatttattcttatttcttaggaggtgctttcccctcttctttctgaagacatccagggataaagaattgctgcttttatgagcacatgttcttggtgatatgctgttaccttatctaaaaacaatacggcctggctgattattctcagagctcattgtaaggtgaaaggttatgcatttgagaattattttcacagtgtggatgggagtggggggagaagatgtagagcacaggtaaggaattccaggttttggggccagggatcgccaagcagtgtaaagggctcactgtggcctgtagctccttccccctgtggtttgtgctgggccagttgctggctccccaaaaccattatcaccattatcattatcactatcatatccatcacctcaccatcattatcactgacatcatcacttttctccatcaccatcatcatcatcatcactatcatccccatccccatcatcatcattaccatcatcattgctgtcgctatcatcatcatcattccattcatcaccattcatcatcactgtcatcatcaccatcatcatcactgtcatcaccatcaccaccaccatcatcaccatcgccatcatcactgttatcgtcaccattcatcatcactgtcatcatcatcgtcatcactatcatccccaccatcaccaccatcattatcaccattctccatcaccatcatcactatcatcctcaccatcatcaccattctccatcaccatcatcatcatcactatcatccccaccatcatcaccatcaccatcatcatcactgtcatcatcaacatccatcatcactgtcatcaccatcatcatcactatcattaccatcaccatcaccaccattatcactgtcatcatcacctttctccatcaccatcatcatcatcatcatatcatcatcatcatcatcatatcatcctcatccccatcatcatcaccatcaccaccgtcattgctgtcatcatcaccattcaccatcaatgtcgtcatcaccatcatcatcactatcatcattatcaccatcatcaccatcaccatcatcattactgtcatcatcaccattcaccgtcactatcatcactgtcattatcaccatcatcatcaccaccaccatcaccatcatcactgtcatccccatcctcatcatcatcaccatcactgtcatcatcatcaccatcaccaccattgccatcaccatcaccatcattatcactgtcatcatcacctttctccatcaccatcatcatcatcatcatcactatcatccccatccccatcatcatcaccatcaccaccatcattgctgtcatcaccattcaccatcactgtcatcatcaccatcatcgtcattatcatcattgtcaccatcgtcaccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacaccttgcctgagggctggctttgcaggtctgagtggctaggtcagggcactgctagtgttttctatgtttgtagtcaattggtgagagtttgttttacgcatttgttaaaactgtgggacagtggtctggaagccaacaaggctttagggttggcagagtgactcccatcccatcattgatgtctggctttgacttggcatgggagacattgcctctccagatctcagttctctcgtttgacaaatggggcttagggttgaacagcctctaagtcctctgtcagctctgcaattcaggaaagatgtttaaaaatgcatacttgcattgtaggtacatccaacatagagcaaagagagaattttcctagctaaattgactgcaaaaaaatgaaacctcttgggccgggcgtggtggctcatgcctgtaatcccagcactttgggaggctgaggcgggcaaattacgaagtcaggagttcaagaccagcctggccaacatggtgaaaccccgtctctactaaaagtataaaaattagctgggcttggtggcgggcgcctgtaatcccagctactcgggaggctgaggcaggagaattgcttcaacccaggaggcagaggttgcaatgagctgagagatctgagccactacactccagcctgggtgacagagcaagactccgtctcagggaaaaaaaaaaaaaaagaatcctcttataatatgcaggcatcttagcaactgccatcttagcaactgccatcttaagaggcagcattatgattcagaagaaactgataacattgaggaatacatttgtggagcacagattaggagagattggtgcaggggtggggggtggcaggaagatattaaggttggaatttagggaggtgagctctgtgggttggtttcatgcatccagctcaccattcaacctttcctgttaacttcctatattaaggaggctgagattaagaagacagggactcgtggcgtaagggcgagacagacatagaggtgagtgactgcagtgggatattcactgtgggagcattgaaggttggcagtcagctagattcttaggctgtagatcgggggccttatttagaagctgtttactgttcccttaagaggatcctctagcaggaaaaaccactgctagggttgttgctttcctcattataatgatgtctttatgttcgtcttaggaggtgatagtactgattatttaagaaactggtcagccaaacttcttaactaattgtgaattagagaaaagtcagaagtagggagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggctcacgcctgtaatcccagcactttgggaggccgaggcgggcggatcatgaagtcaggagatcgagaccatcctggccaacacggtgaaaccccgtctctactaaaaatacaaaaaaaattagccgggcgtggtggcgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacaggaaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcaggaggtcgagaccagcctggccaacatggtgaaaccccatctctactaaaaatacaaatattagctgggcatggtggctcacgcctgtagtgccagctactcgggaggctgacacatgagaatttcttgaacccaggaggtggaggttgcactgacccgagatcaggccactgcactccagcctgggcaacagagtgagacttgctctcaaaaaaaaacaacatccagagtcttccaggaaatttaccgtttcagtgtggcatagtgtagagtttgtttattatctagaatatggtttttcttttttgtgttcttgaacttgggcgttcacttcgtttgttgacctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggcggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaagattaattccagggtgaacaaaggagagggatgctggggccgggctgcctccccaggcaaatcacatcactgtaaaatccgagaaaccagaagttgcctttgctactcactcagtggctgcttgctgtttcttggattagatattgaaagaatcccatctttatagtctactgttcatatttatggtctggagaagaaaatgtaattttcagcaaaattctatcacgtctggtaaataatttcaggatctttacctatgataccacattaaaaaaaattcgtatggcttcagcattcagaaattgttcttttcaaactctgggccctcgggttattacaagatttaacaccgaggcaggaagcctgctcgcctatcactggagacaggtaggttgctatggagaccaggtgtgtgtccctgcggtttcctgggtatcccagttgtcctggaaaagaaatcagctcactttatgtgatatttctgcaatagtgtgtgtgaattaagtttttctaaacacagatcagatgtttttgttgacttacagtgtgatttctgacataattttgtcctcggttttgttttgcttaattatgaatcctacataaccctaccttttcctatcagaagcacttccatgcatcaagaccccctatccaaaacagccacaacaacttcaccaacaaaatctcttaaagctagagatgcctgctttggtgtgaatgatgattaccccttaaaataattcaacaattttttttttttttttttgagacagggtctcagtctgcctctcaggctggagtgcagtggcgtgatctcggttcactgcatcctgtgcctcctgggttcgagcaattctcctgcctcaacctcctgagtatctgggagtaccgggatgcaccaccatgcctggctaatttttgtatttttagcagagacggggtttcaccaggttggctaggctagtctcaaactcctgacctcaggtgatccacccaccttggcttcccaaagtgctgggattacaggtgtaaaccaccatgctcggcctcaacaattattatatatggtttgccagatcctggcctgggcactggggatgcaagatagagcaagaccattggaggccctgccctggcggagcttgtattagggttgtgatcctagaccacatgaagcccacaagggggccctgggctcacccgttcctggctcacattcactgtcagccacagctaaacctcggggcctggaacctctcttgttgtccccatgggacgagtgggcacatgccttgttggatggacaataacatcatctgtttttgtttgatgtgttattattcagaggcatttttcagaatggagaacagtgccttatcagtctgcttctgataattttatacatgaaaaaaatcctatttgtgcatattcttgggtctctccccatttctaaaggcagtcaacttggtggttggctgtaaaaagctctttacacttcctaggacttgtcaaatattgacaagtctttctcctttcatccagttcagcaccagcatcctcaaactcactgaaacagagcatcccacagtggcagccactgtaggccccaggtgggtatcctactcctccacccccgccccagactcccccaaccccagctcgcacctgcagaagttacgtctttgcagttatttcaggagaaaaaggcggccactctttctctcccttctttgggtttgtgttcagcaagggtctactgcagtcccggtgccggacagcctgttttgcccatgcttgttaactgatggggtcctcaagtggccttgtgacaggcctgataaggccgcacgtgggtgtggttagagttgatgaccgctccggacattggcgatgtgaggaaagtgacagactccagcctccatgtgcagccggtgattggccgggtgggctcggttttctagtggcaaaggatgctgtgatctgaataagaaaacaaacctcaggccccaagtgccacgggcttagagacttgagaggaggtgcttgcaactccatctgggaggctaagggcagccaagagctgctgtcttgaggctgacccactcccttgcagtgtaatgggtagtgaacaggccatcctttttaaaggaaaataagtgcctccctatggactctgttcctatcctgctaccctccctgaagcttgaatagcacccacccgtgccttctccatgccagcccttgggtctgccgggaccactgccatgcttttgatggacacggccttgtagcgtctatatcctcatctgtgaaatgggaattccacagcctccctttcgcaggctgcttgtaatagttgccattaaacctcttctgaactctaaagtgctgtatcaatgtaaggaccatcatcaacatcattgtcgtcctcatcgtgagtctttccaaattcacctcctgctgccccagcacgggagtgtctgagactgcaggtttccttgatgggttcctggggcttcccttgtggaaatttgagttctgagccttctgcacttttccatcccccagtctggagtcaacctgtatttttcattttccctctgcaagatgtcagcccataggagaggcctggaggcttgcaggggaaatgggacgatgtttgaaggaagcccccgtgcctgtgggagcatgcagcctcctccgtctttttgtctgccaggcaggggagtaatttgccgttatgtactgggcagtctgggagctggactctcagatgaaaaatgcttgttcaagcacagacagccaggcatggctcaaatcagagcatcgatttagcaagcagctctgctcaaacagccagctgtgtgatcaccttttcaggggatgataggctgacgggcaggtggggtggggtggggtggggtggggtgggcagactaatacagggaccctgtgtttgggagcctctgtttaagcagagaccgggcctggagagagtatccctgggtagggaaaggtgctctcacattagtgggttccacctggccccttggtggagctcccattcattcattcactcattcactcattcattcacatcgtgtctactatgtgccagtctctgtgctaagagagtgatccaagcagaaggtctgaaatcctcagggattcgtttcccagccgacttatgccttactaagtggagcaggttctgggctgcaggggactgacttgctgctgcaggtctgggtcttgaactaagggagaaagacaatgcccatcttcttcttggcgcagtcatttgaggagaggagcatttgcttcttgccaacctgcctgcctgggaggccctcttgctcctgcagccccccgagtcccctttgcagctcccagtcttgcttggggttgcctcctccaagaagcctcctgggctagctcaggcatcctgtggaggcactgctgggccactgatgcctgagctcctgtggcctggctgtctgcagggcttcagtcctggcctttcacttcccagacatgagtcttatctttccacttggttagggcctccccacggacatggacggatatggtttggatttgtgtccccacccaaatctcgtgttgaattgtaatctccagtgttggaggaggagcctggtggggggtgattggatcatgggagcagagttcctcttgctgttctcatgatagtgagtgagttctcacgagatctggttgtttgaaagtgtgaagcacctccccctgctctcccttctgctccagccatgtaggacgtgcctgctgtcccttctgacgtgattgtaggtttcccgaggcctccccagccatgcttcctgtgcagtatgtggaaccgtgagccaattaaacctcttttctttataaattacccagtctcaggtagttctttatagcagtgcgagaactgacagggaccgtgtgtttgggagcctctgtttaagcagagaccgggcctggagagagaatccctggggagggaaagctgctctcacatcagtgggctccacctggcaccttggtggggctcccattcattcattcattcactcactcattcattcacatagtacctagtatatgtgccagtctctgtgctaagagaatgatctaggcagaagacctgcccgctcagggcttctgtttctagctgggagcaacaacagtaaactaaataagcagattatattgtataatatagtaatacttagaaggtgatgagactgtggaaaacaatacattagtgaagagggtgagggtattggatggaagagcgtgagtgtattaggccgttccacattgttataaagaaatacctgagacacggtcattaataaagaaaagagatttaattgtctcacggttcttcaggctgtacaggaagcatggtgctggcatctgctcaacttctaaggtggccttgagaagctacaatcatggcggaaggtgacgggggagcaggcacgtcacatggagaaagcagaagcaagagagagaaaaatgcaaggtgccacacacttttaaacaaccagatcttgtgagaactcactatctcgaggacagaaccaaggggatggtgagaaaccattcatgagaaatccacccacatgatccagtcgtctcccaccaggcctcatccccaactctggggattacaattcaacatgagatttggttgagacatccaagccgtatcagtgagagatgcagtttttttttttcaggggaaagtgttgttgttgttgttgttttaataagatataatttacataccatataccatgaaagtcgccatttaaaaatgtacaattcagttgcttttagtatactggcaaagttgagcaccagtagctactaatttcagaacattttcatcaccccagaaaaaaatctcatagccattagcagtcactcctcaatctcctcgtgccctaggccctggaaaccaataatttactttaggtgtctctggatttgccacttctggacattttatatcaaggaaatcatgcaatatgaggccttttgcatctggcttcctttaccaagcacagtgttttcatgcaccgccaatgctgcgtgtgtatctgtactgcatgcctgtagatggcggaataatattccaatgtatggatagaccacattttgtttatccattcatctgttgatgaacatttgggctgttttcacttttggctattctgaacaatgctgcgaggaacaagttttttttgtacaagcgtgcaagttttttgtggatgtatgttttcatttctcttaggcaaatagagagacacaattttactttttatttattttattttttatttttttagagacaaggtcttgctctgttgcccaggctgaagtgcagtggcgccatcatagctcactgtagcctgcaactctatggattacatgttcctcctgcctcagcctcttgagttgctgggactacaggcataccccatcattcctggataatttttaaatgtttagtagagatgagttctcactagattgcccaaattcgtcttgaactcctgggcttaagtgatcctcccaagttagccttataaagtgctgggattagaggcatgaaccactgcacccagccacagttttaaatagggtggtcagagaaggtctcatgagaaggtgacatctgagcaaagacttgaagaaaataagggcagaagccacacgaaaaccccagcaggacagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagacagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccaggctgaccctgaggtccaccatgactgtgctgcagccaccaccactggccgcttcatggcatgtttccagcacaactctctgacctggctcccccggttccccagacgcgttccccacggagtcccagcgtgtatgcatggggtcacggtgctccacgctctcaaccgttggttgcaggttcccgtccagcctctcaagctggctgctcccctttctcagttgtcccctgtgcctcttgtaccctaacttcagtgttagagcacctttcagggggaatggcgtaaaaaagccttcctttccagtagacagagtgccctggccagcagaggccaaacacattcccattcagctttgtttcatgctggatctggccccaggcctgcacctggccctggcagtgggcgcacgttaggtgggattgctgaagacaatgggtgactgaggcagttacaggtgtcagccccagatgaggctccccaacctgtaccctttaccctggagctggccccatctctcacagcccagtggtgtactaccttaggtaagcaccagttgcgcctcactctaatgaaaataataaaagctcaaatgaccagcactgtcctactgctttatacgcatgacctcaggtaatgagaattagcccacatccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggggttgttattggtttttacattttgtttgcaatattgggtttgctggtttttgtgttttttttttttttttttttttttgagacagagtctcgctctgtcacccaggctggagtgcagtggcatgatcttggctcactgcaatctccacctcccaggttcaagtgattctcctgcctcagcctcccgagtagctgggattgcaggcctgcaccaccacgcccagcaattttttttttttttttgtatttttagtagagacagggtttctccatgttggccaggctggtgttgaactcctgacctcaagtgatccacccaccttggcctcccaaactgttgggattacaggcgtgagccactgtgcccagccgggttgctgttttagttggtttttgattttagagagagggtctcgctctgtggcccaggctggagcacactggtgccgtcggagcacactggtgccgtcatagctcactgcagccttggccccctgggctcaggcgatcctcccgacatcgtaattacatttttgcagggttttcagttcacaggtgtgctctcccacatccccatttaagtttacttatttttcagccccagcctctgaggctatcattattttacagacgagaacaccgggactcagagggtgatttgtccctagtctcagggctccaaggcggcagtgccagcgttggtgggggtccccagtgccaggccagggtggcactgttctccctgtgcctctctgcttgtccccactgcctgcttctgcagaggcctgctcagagcaggtttccagcaaccttcctcgccagcatcctgctaagcaggccctggagggcggtttccctgcttccccacaccgggccagagctgccttgatatttatttcagggcatccctgcagagggaactgctaatgcagtcatggctttaagacgtcacaagccacagctgcaggtgcttcatcttaaacatctgccttcctggctgggagaagcccgggagcacctgctgcaggtgtctttgcacctcggtcctgctggtcccaggcccagctgcggccaattagcacctctgttgggcaccatggccatttccttgctgcatgggagccgctggcctttttccactgtgttgggggaaagttgttgggaaatgaggaagcagttggggatttaaaaactctatgcaggaaataggctgttgggttaacatttaagccactgaacagtcatggagtgtttgcttggaagtgaggcccacgaggctgcagagggccatgagattcaaggatggtgttcgtcaggcctgtccgtcatcctctctgggttcgacaccatctcagggtactcatgcctgttaggtgcttggtgaacaaaggcatcccagacagaatcaacccagaaggaagaggggtgggtggtaaacgttcgttaacttagccatgttctcttagggtttcttctcaaaataagggcagatgggagatctccctgcctcaaggggtccctggccaaggggctacaggcagatattgcccagtcagccccagtgaggtgacagaaggcgggaggtggcttcagtgtgtttgaaggaggctggcatcacaggttctaaagcagatggcaggagccctgtggctgggcctgcttcagaaccttggctggctgctccttggaggtgaggtgggggcaggcagtgttggctggagacttgtggggggaattggccgcctggggtgcgtgctggcctgcctgccttccgcttccgtgccatgagccccttgttctcagctgtgaaggtaggtgaggctgccctgcaccagccagcagactgggttaaggtgggaatcaaaggagaggaggtgttcagctggctggagacctgctgagccccttgcatgaggagggatttctgtccagcgcccctggtcctcaagctcctcctcagcagcgttcatgagcacagggtgtgggtgtgactggtccctttgggcagaatctgagagtgcccccttctccctccctgtgcatttgaaagttggctggtgctcgctgacagatgccgaggctcccgtttggcagctggccatggcagccgcttgtcctccactctccctagatttggctgagctgggcccctgctgtgccccacatgccccggctctttgtctcggttgtccctttggctcagctctgggtgtcggctcctcggaagcccttcgtcacccaaccagagtgaactccttctcccaggtggccagagcatgttgaagtgaccctgactttcttctgtgggtcctacattttagcggggagtacaagtgcctcttcactgcagcatctcctaaggaagtgagcctgtggggaggtctctgatgctactgggaatccagcttcaccttcccccaactcctgggatttgcagccacagctaagagtgggagaactttgccttgtttgcattgctccagatcgtgttaaacagaatttcaaaacatgcattttgtaggtagtagttctgtcatccagaatgtgtaaagtaactctctaggtagctgttatggatggcctgcaggaaggatcataccagtgacttcttttgagccccctgccgagtggctagcgtcaggtgggggattagactctggttctttgcttcctggccctgtgagccccaggcaagtcagttaacttcttggagcctcagtttcctgacatgcaaatcatactgacctggtaaggctattgtcaggattatatgagctattatatcctaaagtatattatatcatactttatagagcgtagtatatattcaactaactgcatttgtgttagttcctttattttgttaacatggggatcaatggctttttttttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgatttatggttagccccggatccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgagctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaagatcactagtggtgagcctttaaatgcctgtaagctgtccgaggggttcttcctaaattaaattaaatttttaattttaattacttaatttttttgagatgggatcttgccgtgttgcccaggctagtctccaactcctgggttcaagtgtcctcctgcctcggcctcccaaagtgctaggattacagatgtgagccgccactgttggtctctaggggttcttatgcacctagaatttagagactcattgctccaagcttcattgaatctttcctgaacagtcttgtgataggcgggataactcccacccctcagatgctcacatccgaatccctgggacctgcggatatgttgccttatacggtaaagggctttgctatgtgatgaagattgaggaccttgaggtggggacagtatcctggattaccagggtgtagtcactgtattcatgtaagtccataaaagtaaggaacctgtcccagctgcagtgagcccgagggaggtgtgactctggaagaagacgcagagatgaaacactgctggctctgctgacaggaatggctttgagccagagtgtggtggcctacagaggctggaaaaggcaagggaacagatccacccttaggtcccccagaggaaccagccctactgacacagtctccgtgggacctgtgtccacagacagaactgtatgaaaacacgattgtggtgtgtaagccactaggttgatttgttacagcagtgacaccgggctttgtctctgcttttgacttttcctccagtgtgatcccttcccctgcttctgacccgtggatcccagccctgcccaggcccagatcctgggctccaggtgggcctgggttggggctcccagctgcaggaatgcaaagttcatggttctacaaagtgctttgaggtgacgttggtcacatcagctcggcctcagatttgctgctttttttctaaagaagagacagctccaggccctgcctgactgacctagttggggatgcaggccgaggccatatcgagcagggtaagtttccaagaatctggctttaggattagtcgggccacacggaaggagttcctggtctcgtgacacctgcacaaatggtcttcaaccctcaaaacacttcctgttatttaaatcttggtcctttgattttttttttttttccttttagagactatgcacaatttatgtggcaagctagagatgctttctttttcagagcggcctttatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccgtgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccgtcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttcgggaggctgaggcaggaggaggcttgaggcctggaattcaagaccagcctgggcaacatagcaagaccctgttttgttttgttttgttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgatggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaactgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaggaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggcttgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaacttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcatgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaagatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacaggtgtgaaagcccttcttatgttatcagtattaccctaatatatcagagggctaggatttctcataaggcgactgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcctgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaatgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatgctgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggggtgctgggcagacgtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcacgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgttgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1751 - DNA, 97455 bp, Homo sapiens
  source 1..97455: mol_type = genomic DNA
tatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccgtgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccgtcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttcgggaggctgaggcaggaggaggcttgaggcctggaattcaagaccagcctgggcaacatagcaagaccctgttttgttttgttttgttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgatggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaactgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaggaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggcttgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaacttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcatgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaagatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacaggtgtgaaagcccttcttatgttatcagtattaccctaatatatcagagggctaggatttctcataaggcgactgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcctgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaatgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatgctgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggggtgctgggcagacgtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcacgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgttgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1752 - DNA, 58940 bp, Homo sapiens
  source 1..58940: mol_type = genomic DNA
ggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1753 - DNA, 58854 bp, Homo sapiens
  source 1..58854: mol_type = genomic DNA
actgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1754 - DNA, 65535 bp, Homo sapiens
  source 1..65535: mol_type = genomic DNA
ttcattcatttttgagtctactttatttacagttatttatcctttcttgaaaacttttagcatcgccttgattaaaataagttcataaaataatcttcactgtatttgttacatatggcacagaataatttagcactttataaatatgtctcattgatgcacaaatgggaggagcaccctttgctgaaagcagtacagtgacttagttcaatttggctacggtagcactttaaaaaattaccatgagatggcgctgtggccaagtaaatgcagtatgctttaaacagttttccctaattatggcagttaattgcttttttttgaatatagaggaatctatcattcaacttaaagtagagcaaggtttgttactccgttttaatagtattcattaaaagtgaatcctttaatcacagatccataaatcatttgacaactgtgtttcacttaggtgtgagtctgtttaaaaagccatagtagtcagaaaattgccagactaaacaaagggcccaaaggtaccattttatttaggatcaagaaactatatatgtggaccattgttttcgccatcctcatagacttgtcttaaagttcttccacaaaattagattaatttccagtttatttaaagagctgatatttttgttacactttaatctgctttgcagcaatggaaggtcatagaaatattagaacatgaattcacatttaaataaacatgatacaaacatgcacacatgtgtatatactgagtgttttcattgacttgcttttcgtccatataaatatataaatattgaataaagtgcatgagaacatgtctgtacatatatacagctacacatttgcctatacagtatacacttgaatagatacttatggaagaaaaaaacacatacacatttgtaatatataggtagtcaaaagacatctatcaggcaacattaatgtacattctgatcaagattgagtatatgggggtagaatctgtaatcttttccctaatatataatgaaatgtgcagagttacaagtgaaggcaaaatacattagagtggagacattttaacatttatattttcatcagttagtatggtatatcataaggagtagttcagttcaaatgcagccttggtactagcagcatattatacattctatctttgaaacagtgaaccatctttcaacatatctatgaggacataatgagaattttatgcatttccaaattacacaatgacacttcccacattctttagttttcaaatctgtatttttttcccaaaggtttagggcaaacactatttctcattcaatagaaatgcttcagcattgtaatcatatatataacattgattctaataacaacatgcaatttaaccttgagtgttataatatcaaggtggattaactgttgttaatctctttttctctttagtaaccatttcaatgaaatattataatatctgcttttctattagggagcccagtgtcaatgagtaatactgaaatgagtgagtttttggagaaatagaagaaaaattttgctcaaaactatggtagttataaactggcttgagattgaggtgcgtatttctaaattaattgcaatgttaagcctcaagtgatattttccccctcctttatttgtttggtgtttattggtaaccaatcaggaaaacttatttttaaaactactctcacagttgaaacaaacttgtttctgaaccaggtaagaaggaaataagttgaaatgattctaaaaataagtctgtatatattttttgactaagaccatttcagtttagtcattttctttttttctttctttttttttgtgatagggtctcactctgttgcccaggaggaaatggcagtggtgtgaacttggctcactgcagccttgagcttctgggctcaagtgatccttgcgtctcagcctcccctgtagctgggaccacagttgtgtgccacaaggatcagataattttttgattttttttgtagagacagggaggtctcactttgttacccaggttggtctcaaactcttggcctcaagtgatcctcccatctcagcctcccaaagtgctaggattacatgcacgagcctccgtgcctggccgagccatttcgtttgaaggcaaggattttgttttaattatttttatatttctcatatctagaaatttgcttcacacataaatgtacactcaatagatgattgtggaaccaagcagaatggttttaataaatagtataaaccgatggatctgaaagcatcagtttacctgatgagtgtcataggaaagtcacctgctttttacagagatgtcctaggactctaccactgtcagtagccggaaacctgagttcatcctcaatcctgacacagttacatcaatatacatttactgctcaaaagagtgcatgcatgatgcagtcatttcacagcaagttaccaaatacctcgatagtgctgttttagagaagcaattgctagaaaggcatttggtaatgttaaatcatccttttgctagtttacctagaggaacaaatattaaacaagaccacactggaaattcagagtaaagcacaagaagtagaagagaaagcagcaatagttattgaataacatttgaagtctttttcacttctgagaattaacttgaaatgcagcaaatgccagcaaccttgtgaatatttcaaaatggtatctatgaaaaagcaggaatgaaaaatgttgtcaagtatttcatttaattatcttagcaatacagattttataacactgaccttagtggctttttttttctcctttcaaaatatataccatagtaagttttaaagataatttttaagaggccattatattcaataaaattttcactatttatagctatttttatttacagcaataggtaaccaactcaatcccatgtcatcaatgaacagcatagcagcaaggtttccacttgaaaatagaagttaatttagatttacttagggcttcataattatacaataaaagtgaatcattttaaagacatatcatttacaatgttataaataagtatcagaaagctcacagctgaaatgctgtcagaacattttccaagcacacattttgtagcattgaaccccgcttttcattgacagaataaaatgaggcatacagatatgatcgttggttccactagacttgtctaattttttccaatctcatatttttttttttccagataggtgaaaacttgctcagtgtgccttccacagttgccacggcaactagcctatcacacacagctcaccttttcattcactccgtcgctattgtctttagaagcctcttcagaatgctgctttcctagagcaaccattgagcagtcattatctgttgtcttggcatcttgctttgaattctttttttgtcccatttgaagttggctagacttgtaggccaaagccggtattgtgttcactaaaattaactgcaatggttttttgttttccttgtactgacactgaatataccgtgaaaaggctgacctataggtcttgttgaacagtgtgtagactagtgggttgactgctgaagagagataaccgatccaaacaaacacattgagcagggccccaatgacatcctcattgcaggactctttgcagatgacggccatgatgtttgtgatgaagaaagggcaccacatcaccacaaacaggaagaagacgatgcccagcaccttgcatgccttttgctcattgctgatggactgcatagtcctcctgcctgtgtaggaccctggctccctatggatcgaccgctggaagagcttttctgaagacaaagaactctgagggaggaagctgaaagaagctaatttggcccgtgtgccaagatcacttacacacaaagtagcttctttctggagtgacttgatagttagaaagtaggtgatcaccatgatggttaagggaatgaaaaatgacacaaaagagccgatcaggacaaagttatcatcggcgagtaagcaactcccctccttaaagaccttcgaatcgtcctgtagcccaaagactggtattggcatggatatacctggagttgaacagaaaatgaaacatgattattaaggaattaagtatatgaaggcaagagcatcatcacataatattggctattgaaaagattttatatcatcgtttaaaagcttaacatactttgagaatttaaaattcctttggacttacatatgtgttttgtaagtatatattatgtagttacttgtatgttatattgccctatatagctaacccttataaagaagtataataaatctagctttattttttatgccacatttttctgattataatattatacttattaattgaagaaacacacagagaggcaaataaactaaaaattgtccaataacgtcaccatctagagatagccacaattaacaactgatgctgttcattttatttatttatatatttatttatttttgtctatgaaaatctagaatatagatttgtttctttttttgatgctgttcattttagatacattcacacacttaccatgtgcacacattttaaaacagaattgaggttctttttcacaaatagttctgtatcttttttaaaaaatctaataatatgtcacaagcatggcttatatataaaaataactataaaattttaaatatagtttattttctctctagaaaatttgggaggtacaaaaatgtaacaatgaataaagaaaaataatatgtattctcaccagtcaggggcaaccataatttacatttgcatcatttcttcttccacttacatgtacatataaaagcaaatgtgtatatgcagtactttacatgcagtactttgtaccttatatgttttagatcttcctattccatttaacattataaatcatgataattgcacataaaatatttttgagaaatacaattttctaatattaatttaaaataaccaattttaattctttttaaaaaagcttttattatgggacatttttaacatacacacaactaacaaaccaaaaaccaaacccagtacagtgaactcgtcacccagcttcaaagattatcagctcaagcccaatcttgtttcatccatatgtcctctggctgccatccctcccatgttattatgaagcaaatcctagacatcatgtcattcaatctgaaaatatttattacgtagatctaaaagccatgcactcttagacaaacctaatattttcacaataccattctcactcctaaatagaagtttaatatttccttaatattaaatgtagagttagtgttcaaatttccaattgtcccataaaggttgttctatgtttttagtagtagagcattcataaggatggattgcaaaaaacaagacagccatagactttttattgacaaatataaaaagtaggtataggatgagataatacaggggaacatgggcctatatggttcattgctccatcacccagatttgggggatctgtaaggctccctcaggtacagggattaggcagaggaggaagcagaagtgaataaaggcaacccctggcctctaatcatgctatgtgccccacttgatgataggacctttttaaaggaagattcaactggccatgttgtgcagtttcaccacccagcccccaccatggacaacctctctgctcctggggaaataggtgtatctttctctactggcctgggatggttggtccaaggcaatcatgagatggcttattctctctgccataaaggtagaatcaggatgataaaaaagagaggaaacatgaatcaagtactctgtataacttagtttaagattgtttctttcatgaaatggtagatattgcagggacagcctgggagaaaaagtcagaaaaatagttcccttctaactcctgcccatattatcagcacactcagaattgtagaacaaagagtgttgtggttactgcttctgaccgtctttagagtctaatacatggtctcacaccagccaagaacaccggtttattccagaattgggggccactgcctcactcttgccatccatctggaaaaaggtttttggagaatctctaatctaacttctgcatactcagaacagagttccgcttcatccaagcacaggcatgactgtcctaacctcatgtcacctcacattggccatcgtggccaggaaagaacgctgagttgatgtaatattcaacacaaatctttcttagtgacatttgccattatcttcaaagacttaattaacaatatttgtcacttgcctatgcaagcccatccaggattcttggaaggtggagataaatgacatcagagctgttcataaggacacttattgtggctaatgactcttcatttcctccatccctctctgttcctggcccattgtttgcaacattcaagaagagattgatgagctgtgcctccaaggagaacatcctctgagaccctggatattgaccagttttgcttatccttcggaaaactcttgattgtaaaagtaagggcatgatttctaagaagagtgtttttctcccagtgtttgaatctagatctgtgaaagatatttcctgtactcatgtacaaggtcttcttagacagcacagttgctcattgattagaaaggatgctttgttcaaccatttgagacatccctggatttgagtcttggctgtggctctgggctcctgaattggttacttcattcctatagtccccacttcttcatctatcgtgggaggctggcaccaacataccttcatgcatttggtgaggataaaatggatcaaatttgcagagcacctagcacagcacccagtccatagtgatgttctaccagtggtcaataaacatgagagtagctttctctgcagaactatttatattaaatatatcaacattattttattctaatccattttgcttagtttgtatacactagattttatatagcagatctttttaaaccaaaagagactaaaaagacttttggctattggccgtagagttaacactgatgtaattttagcttctgccagggtgacgccgggtcttaatcaattttaattttgtgcagctagaactgttgattactttcctaatgtgatgaattacagcattactattagtcatgatacacagaaacaagatatcaaccgtccaaaaaaggtgtgtgattttgttattaaactcttgagtgttctttttctaattaatacaaaggaagtaactaccttgagagccttttgccctatttgcttataacctagtaatgtacataagtggcaattctcaattaaccagaatgtgggcttacctaaaatgccaaattctttaattatttggaatagtgtctttggttggacacacacatacacacacacacacacacacacacacacacacccttacagaatagcccagtttctgagaggggtgatggagtcatctgcactgaaatagagaatccctctcttaaatgcccgggataaaaagccactctacaagaggatgtggtaagaggttacacgcagagctgttctgtctggaagggggatattaatttggaagtggagaatcaagctgatcagttatttaaatggcctattcatctttacatataacaaaaacatcctgaatactatcgtataccattctttttccatgcctcactcatagtatctggtcagcaagggttgtagaaagaataaccagaaagttaaagtaatactctataaagaggagaggaaattttatgtcaaaaaacttagaacacatagataggctttgtgggtacaatcagcagctcaaaagcatgtgcctctaccaagagagatgaagacatgggctgatatccaatatcgtggtcacagccatctctagggcattaattatctggctgctttgtttgacaatagctgcttttggagacctgacatctcctctcacttgaaatttctgcatataaagcattttcctttatgaacaaaacagacagtaacctgaattacatgactctgcattttgtttaatatattttttctgaagagtggaaaacagcagtcaaaattcactatcagtattagatcctctatgtagcattttattcatttccattgaaactcagacaataaaatgaatgggaaaccttgacacctaagaacacaaaagctttggttggtgtctttctttcagcatggctctgcttacttcctgcacataaactttgcacctctagttaacatcttaccacaggctgcatcaataattcactttgaaccgctggctgtgaaggactggctttattcttaatcttggactttttctgagacagtgtacatttcttgggaaataagaagattgccttcctagataaccattctcttgtagggaacaggacagtggcagtccctagggccctcagctggaaaggaggtggagggcagagaagttatttcggggctcttgtgaaaaagattgaaatttgggttcataggtttctgtttccccaaactgctaccttttctttgaattttaatgcatgctgtatttttcaagttataagaacaaatttactagtagtttgacagaagacaccactggtaaacactgcaggataatcctcatattacagggaaagaagaattgaatatatagggcaactgccaatgggactcactatcctgatacagagtggctaaattccttctaatctatgtatggtgtgttgacaaggcagatgtacataaaaatgagagctacacaaacatgtcagttacccaaaagctgtatgtttctttttctcagattaattccaaatagctctgataataaattgcaacttttcaaggtattatcacacatatttgtttattcactctaaattgatttttacaaaattgttaaaacattacccacaccttcttatggggcagatgaaaatctcactttacagatatgaaaacttgggcctaccaagcttaagtaatttagttagaatcacacagaaagttgggggcaaaatcaagacctctactcagggttcttaattcttatggtggatttttaaaaactgcttatttgttcctttgaaggtagttacaaaagtctatgactacctctgaggtttttaacattggcttcaggaagtctatgataatcctaaaatctgaaaaatttgtatatatgtatatttccttggagatagatctttccttagatgggcagaaaaattctagcccctaatatgactaataagcactaaattacaccaattgatatggtttcattctgtgtctccacccaaatctcatcttgaattgtaatcctcataatccccacatgtcgggacagggacctggtgggaggtgattggatcatggggaggtttctcccatgctgttctcgtgatagtgagagttctcacgagatctgatggttttatgtgtttgacagttcctccttcccacgctctctctcacctgccaccatgtaagatgcacctgcttccctttctggcatgatcgtaagtttcctgaggcctccccagccatgtggaactgtgagtcaattaaacctctttcctttataaattacccagtcttgggcatttctttatagcagtgtgagaacagactaatacgccgatgttgcatgtacagcacaaactctctctctctctccaccacccccaccagtgattttctgtaccttgattttgtttttgcattctttcatctcaaagccacaagttcctctagccagacattaaattcattgaggccagaaaaatagttcaaaaataaaatccttataatcaacatttagtttctttcaaatactagggaagttattctcaactgtagctgcacattagaatcactgagggagttttaaaagttacattgcctgagcctcattctcgggggttctgatgttagtactttaaaaaatataaatgcccaggcactacataaacatgaaaacaacaaccactccagggatctctgtaagcagttgtgcactgcagaagctggtggcctaattgcccccatcatagattccttataaagtggtctctgtctcctctgaccctccttccttttcttttccatttcatagcctagaggttgtgcttcaatataaagatcttgcactgaaaggcgaagagattgaattctggcttgtagatggggcttgtcagccgtcactgcaacacttaagaacccatccacatctctcttgtctcagagaagattgactttcatctaccatttcagcccccagacaatatattacaaaacccaaagagaatctgaaccatataatataatttgaataaataaccagagccttgttttgttgttggaatcacaagtaataaggcaacttctgctgatcactatgttagttagcttaatttcatcattctacattgtaggcatcgaccaaaatatcacatttgtacgtcatcaatgatacaattatgattcacaaatgaaaaataatattaataataaaaataaaactcttcaatgccacagaaagttgggggcaaaatcaagacctgcctccttcttttttaatgagtggatattacactatctacccctagcaggtgctcttttctaggctgcatatttagcaacgtgctcatgagtaaagatttatttagaaaaaaaactcatctctgtcctacattattgggccccatcttgaaagtattgtatcctttctcccatttctatcaagggggcagattttggagtgattctctctgaaagcttggagaatgagtcttacatgtgacatgtctcatttcagagactctggtctagaaggtgtggggagaaacagccatggtgtctggaaagctagattgcggcaggtgcgcacataatctagacccacaacagtcagttctctttcctccagcctcgcttgtatgcagcatcctaaagcaccttttccatcatattacacaagagcctatagtgtccctaacactcgagcaattaccagctactcagcccaccctacagggtctttgtaatctgattttaacataattattcaactttctcaatagtcatatggtgttctctctctgttgctctcttctttatgttatgtcttgaactattcaggaggatattacccatagcaagatttttcaaccagtcacagagtgtgatttaaggagcccccaagtcctgcctcctctcatatatgtcttctctcagtagcttgcttggtatacagtagtcctcccttaagcttgctttccctttccatagcttcggttacccagtcaaccacagtccgaaaatattaaatggaaaatgccagaaataaacaattcgtaagttttacattgttaactgttctgagtagtgtgataaaatcttgtgttgtcctactccaccccacctgggatgtaagccatcccttggtacagtggatccatgctgcagatgctctgtgcccataagtcacttagtagccatttcagcagatcaactattgtgggatcacaatgcttgtgttcaagaaacccttattttacccaagaatggccccaaagtgcaagagtagtgaggttggcatattgttataattgttctattttattattaatgattgttagtctcttactgtgtctaatctataaaataactttatcacaggtatgtgcacatagaaaaaacatagtatatatagggttcagtacaatccacagtgtctggcatccactaggggtcttggaatgtgagccccaagggtaaggggaaactattgtactgcagtgtctctctgttagagtgagaggtccattctgtgtacctataataccctggagggttgactattaacctaagttcatggtgcagcagcacaaagacgcatagtagggaggactcctgagggcataggccttggaaaggaaggttgccctaggagggaagacatacaagattgctcagggatgcaggtctgagggaggtatggtggctgtgccatgctgggctgttcgttaaagcccagagcaccatggggaaggggcaatctaaacggctactgggaggtacagagacttacttttcatttttgccctggaccaattttgatgactttcctttccctgaaatgctacaccaatgagtaggggctccaggatttctatgtagcaggggcttaggagtggcggctggagggcatgggggaatgaggcaacctgtcttgaggctacatttgcatacaaaacacattattgtactttaactgtacaattatttgggagtgctttgggaatctgcagatggagatcatgtttccaaaccacaccctacaatttttttcaaaacgtatctcaaggcacatccgctatatgaaaccttccccaaattaattctctctataataagaactatttttcttactcaatattccttcaacacctccataaataaattatactgtgctagttcacactttcaatatcttagaatttttctctagacatgtcattatattcatgagatgacaatctcattaatagcagggatatctttttctttgtgtattgtaagacatcccagcatcgaatgtgcttctgcttatacttagagcttagtaaatgcttgtgggattgatgggtaaacaaatgagagagaggaaaataaaagagagagttgggaattataatacactttatagacacagcttgaagttactgaataatttcgtaatgcttcccttcatttttgttgggaaaacacagtaatgaggctgccaattagccacatagggtggaaaaaagaaaatggacatttgtatgatacaaaatttgtatactacataattcgtacactcttttaagggaggcacatataggattaaccagcacatgagctgaccaccttaacagctaaaatcacaagggaaaagatcgctgtagaacatggtgcctagtgagaatcaggagacttgcgtttattcctgtctgttctgactcatatcctggatctaggcccgttatttttcacaaagtgtctttcaggtaaattaaacaagtatgtatcagcaaactggagcatgaatatagtgggaaaatcacagaatttggaatcacaagacacaggtttgcctccagactctgttaatcactagctgggtgaccttaggctgcttaactttcaagcttccatctgtaaggtggagataatataaagaggcctcctctaattttcatgcaaggctttggtgaaaaagcagtgagatgatgagtctgaatcattttgtaaagttttaagatttatttagatgagagtgattataatttacttagcactatgtgagactctgggtaaagcaaaagacctttgagacatttcatgatgtctaagatcttttttttttaagctttttattatggaaaattttaaacacacgaaactacagaaaatagtactgtgaaccctatgtacacatcacccaagttcaatataatcatgatgtctaagatcttatagggaaaacaaaatatacacaattgatttaggaaggcagcagtgcaggacagaatgagatcgagaggcaaaatagatgacatagataaattcctatgtgatgtcacagtgcgaggctcattgttggttggcatccctgggaaaggcacaggagctgagctgggcctgtgaatgaatagaatctggacagggatgaggcaaggagacaggagtgatctctccaccctgggcccaggtgagcctggacttgctggggctgaggcagtctgttgtctggtatgcaactgtgaactcaggagcaagtgcacacattgcttatcacttaccagaagcattgagcaggtcctctatctatgatagcaatcagttttgttccttcatccatcaatcaagtagtaattgagcctacactgagctaggtacttgaggaatttgaggggaaggtggttgagtctataatcagttactttacaatctaacaccttcactaccattcattaattcatcactccaaaaaaaaaaaaaaaaagaaaaaaagactagggaggcagaggatacagagatataagcagaaaactaggatcttacagggaaatatatctgcttctgcttcagtctgttgtgaagttacatagcatgtatcctctggaaaactctctaccctcttaaaagggtgaatgggagaaaggaaaataatatcttatcatagtcatgcacccataacaatgtttcagtcaacatcagactgcgcacacaacagtggtcccataagattagaataagattataacactgtatttttactataccttttctgatatgtttaaatacacaactaccattgttataattgtctatggggttcagtacagtaacactctgtacagatttgtagcctaggagcattaggctgtcccacacagcctaggtagggaacctgcagaatatgtttggaaagccactgatacaggagaaaaaaagccattagtttgcaatgagaaaacccaaatttggatcccctctggttttaagcaagtcatttaattggagttttttttctcccataaaatggggattaacagtgtacccttcaagagatgatcatgagaaatataaatgagaattgctacccttatatagtaaatataaagtaaatactatatagtaaatatagtattgtctaacagctggcaattatagagaagaatgttctacagccatccttaatgcccagagttcttcattaaaaatctctgctgtagctgaaacctccaaccactcttgtttggtgctaacagaaatgaaaaccagtttaatatcatctttatatttagtttaaaaatctgtacattgcttgccactttgcacataggtctctgttaatatggaaccagttcatcacccaagataggggtcctgcagagcaagaatgtttcccagaatggctgataatggtctcctcagtgaaaattgaatgacctcttgactgtggatggtgacaatgaagtcaagtgccaagggtgctgagtaatgggtgtgcaatgtcatattgccttaaaagtacacattgggattcacagaacaaggacaaaagagagacttccactgtgtcctttctctgtgggaagaagggtggtcatatgaaatctgggacttttttcacaggtgttgtgttgacaaggaatcagttctttgcacagaggtctatgttaatacggaatcagtttctcacccaagacaacagaaggacctgccacagtgtcactagtgtcatttctgtccagggaattcagtcatgcaagccctggaaacctgacacctcagctgtgctggcaaaaatgggggtggctgactcctcctgtttgttcattttgctcttttccaaattgcagttttgccagcatgctgctctttggtggaactgaggctataagccaatgtcctagctacaaagaagggtgggaatttgagtttcgattcttgggaatttcccaaaatactgaaaggctagttgaaagaaatatggcaggcacccacttcacttgacctacggcatgatttgtagctgctgtaattggggcagtgagcgggggtgcctctttcaaagatagttctgctaggatttctaccctttttcaatttcccacttttttcccctatgatcttcctctctttttctggcatctctgcagtcaacataagttcaagtgtttaacagttaaaaatgaatccatctgtaaacataaactatataccaatagctatcatctcaaatgcttacagggccagtgaagtaatgtaattgagctacctgttggcagataagatggtaggaagggtgttgcttggtaaactggatagtgcctgagggcaatcaagttcaatataataagaaacaaaacacattgtgcaagccaaacaaaacagatctgtgggctagacacatttttcattattcaattagcttggcacaggtttagagctttacaaatttcttttgggttcttctttatttccatctcttatggacttctcatcttggccttgctcttgtggtcactgttctcgtcctgatcagctgacactatttgtaccacgaggcccaaacaactttttgttttgggtcctaaatcctaagattaggcaggatctttcttagtttgggtttcagatgcacgcctctgggattcggataaaaattgttatcatgcagatagattagtgcccctgggcactatttggggcacagaaagtccctaactagcaacttcttcttgtaacccaagctaaacttctgtatctccctcttgtcttacccactgtttcctagagcttctaggattctagaagcttcttcacagtttcactttttatcactcaacagtctggttggctgagacctccaaacttcccatccagctcaggaaagcccaagatgaagaccttttggttttactgtctttcagtgagtgatatgaaagcctctactctctgagatttcatttactccatctcctaaaaagttgtacataccctgaaacattagtgatttggagggagaattttttgttcgttttgcaacattgtagagtcatttctatggtttaatttctgcttgtgaaggccctgtcttccccagtcttaagtatgcctttagtttgcagaaagatgcactgagttcaggttaaaagcagctttaatcaagaagtttatctggttgttttcaagatcttgtacagatttttcttgaagagatgaaatagagcttagcgattatctaaggaagcagctttctttcacagttaatgagtcaaggtagaactgttaagctctctgtgtaagtttaataggtaaaaagtgggggaaaaccccacatttacaggtgtccacaatgcaacagacactatgtaggtcttcacagatgtcagcacatttcatcctcacgaggaactcacaaggaaggaattattattcccattttacagatgaagaaaatatactctataacttggtctaggccttatacttaataaatgcacaagctaagactcaaatctacatctgatttgttttcttctgtacttccattttttgttagaatctggaccttatgaaccctaatctagtgttcttttcatgacatcagaagagtttagttagctttttcattgtttcattttgtagttcatactttttgggttttaaggattaagagtgtttactcgtaaagaactttgagatgcatatggaaattactgctatctgatattacttatacgtgggaagcaggaatagaaacaggagataggaaactgaaaataacaaaacctccaccccaagggctaagcattgtcataataagtaatgaacaactgagacatttagctgcctccttggcctctcaatttggatgtctccgatgggcatccctaaccttacaccgtcacactaggactctgggttgcactcgctcaccccccacctttccttatcccagtaaatggtcctaccatctatccagatacacagcttaaaaacttaggagtctctttccattatcctgcctttgcaaaagactcaccagcattctaataagtctacctaataatctatcctaattttacctgcaaaatatactttttgacctaatctgcctacttctctttctccactgccatctctgtactctaagccactaggactcctgcctgaattaccacaagaccttccccactgccctcaaggggctcccatccttacctgtgtacctctgagcctaagaccctcagagaccccgcactgcactgagaataccatccaaactccttactttggctgcaggccctcagagatgtggctctgctgacctctccttccccctctcttctcactcccttcctttcttactacacttgagctggactggctgctttctgctccttcaaccccgtaagctggttacttcatcagggccttgggacttgctgttcccactgccaggaacacgccactctctactgatattaccatggctggcttcttcttatttggtgtccatgtaaatgccctctccccagtcagccttcctcaccctgcctgagtcactctgtagcggatttctctgatttgtttttttcctttagcagttgccactgtatgagattatcttgtttggtctatttatttgcttgtcatctctctgtttacgtgaatgtgagctccataaaagcagatacttttcctaagacagtgcatggcacatagtatttaaatattaagcatgaaataaagatttctggaataaatgaagaagcaaatgcagaggcctttgggaacacatacaacataaaaagaagaggagagaacaattatgactacctagtagacttccttattaccttagttatcttggcaagggcaagaaattgcccaaatatagatcatttgggggctaacaattctgacaaagtagggctttatagaagttgaaggtaaagctagttaatttgaggactttccctagacagagccctttctctaatatcctagttaataataatcatccatctttacatgctaacagtgcatcagggaggactatgtcatggtggtggtagtaaataataatgataaaaaataacacaatcaaatacttacatggtgcttactgtgctccaggcactatcctaagtgctttatacagatgagctcacttactcctcacagtcaccctatgagtttgtgctattattatcactgtttgctgatgagaaagtggaagcacagagaagttaggcaagttgccaaatgtcacacagtaagtgctgaaactagaattttgagccacagcctggctctgtagtctgtatttttctatgctctgtagcctcagcacactttcgccatcaggtatgcaggcttggggatcaaacttcctcacttcagaaaagttgctgcttgaagagttgctgcttcattgctgctcaaggctggctcttagatccggagcctggaattcatgcagtgtcctacctatgaaatctttctgtggggacaggcctccttttatctgtgcttgtgttgcaggggctatacgtttctcatttagagccatttacatgctatctatgggaagactggctatagaaaccatcttttaagaacttaatgctaaggaccagttatgttttactgcaagtctttaatgcacaatgccaagatcaacattttttgaaattacaattttctctgctatttcttacaatgcttattttctttccatggttcccagctaattggtgtcccgtacctgtgctgatgttgaatgtttttcctccaaattaacctatagatgatttctggggtgggggtgaggatggggcagaaaccctttgaaaaggagtgcaaaagttcatgttcatgtgactacgtacatttttcaggaaagaggtaattatcccaatactctgcaacacaaaaaagattctgaatcactgagcctgggtgtacaaacactatgtcttgtgtgtatgtgtctgtgtatatgtgtgtttcctagtaaaaccagtttcatatcttcatagttctatttcttctggatagtacttttctagagaatatggcagtaatttctaattttaaaagacataagaaacaaaagtcacagtaaaaatctaatcagccaaatagtttataagaaaatgcaggaaaaagataaagaatgagctccttgatacattgtatattctggttcaaacatagtacatgcacagatacatacagcacaaaacacactaactttaatatcctgtggagaagttaatttgctggattacacatatgcatgttaaatgggagcatttattagaataagtcagaccaaaagaacactttcgcacggaatatttatataatggaaacagggatttctgaaaaattgcttcagttttccaggtggctttacaagggcaggatggatgtagagtaactgggagagagactctccttttagcaacattctgggcatgaaaggcagttgtggatccagccaaataagctgcaaacttcccgatgatatattcaccgcttttctacattttgtgatagtaataaggaaggtgttagctctagcctgctaaatgtttgaatctgatgcattttgtaatcagcagaataatggtccccaaagatgcctacgcctaactcctggatgctgtgaatatgttgtgttatatggcaaggataaactaaagttgcagatgggaattaaagatgtcaatcagctgagctggaaataattagagtgccctggattatccaggtgggcccaatgtaatcacagatttccttaaaagtggaagagggaggaaggtgtgttgggtcaaagtgattcaataagagcaggattcaatctgtactggctaccttggaagataacaggaaaaggaccgtgggccaaggagtgtaggtggtttctagaagctggaggggccagtgacatattttttccctagtgcctccagaaagaacgcagccctactgacaccttggttttggcctggtgagaccaactttggacttttcacttccaaaactgtaagtaataaatttgtgttgttttaagccaacagcagaggtgtcatttcagtttgtagtcattgctacagcagcactaaggagctggcacacattgccgggactcgctctggcgcttgggcggcactgtaggtgtccacgttcttggaggtagtcagcaaaggggggctctctcggctgggctggccacgtctgcttacacagagtgctaccctcttcccactgcggtaacagccttgccttagcccctgtgtgtttggagtggcattcgctacaaaagttctttgtcaaagggacaaacgatgagctatgatgccattcagactgatgtgttaacttctaagctttcctatgattaagataattgttctatgatatgaggagcggcattgcatgcagtatatttctttatgtgctgttaaaatgcagttcacggctgtagacaggtggggtgaaattagcaccagactgggagacagaagccctgatttctttccttggcctgtccacatacaagctatgggtgtaatgaacttttgttttcccataaacattttaaaatcacttagtcatgctcctcaaaaaattttaacttttggattaaaactgttgaaactgtagataatctggtggaaaatgaacaccttagttctacagttaacaaaggtaagttatctcaataatttgaacatgttatatttttatctacttaggtcttgtctgtcctataatagttctagggcttttttttttcctataaagttcctggtaattcttatctgatttttctttttctccttaatatagtgcattattctgaattgttaggtaaaagttggtctgcttgttgtcagtatcttatagagtttgtgcttctcatatgcctagaaattttttcttgtgactttatatccccttcaggggatataagatgccgtgattaatatcgtacaccaggagaaggggttacagcctgtgcgcctcctggtgatcttgattaggaagaaggggaaggtggaccttagggcagatggcctctagcattgaaatgtgggctcccagatcctccatctgtccacatcttgctggacacctccatactcatctgcctgggccacttctctgactcccaatcccctaacccttgggctgggaggagaaagagctcagaagccagcaggttgctctcttcccttgctgtgtgctctcagtggttgttggcagcacactggaatcacctggcagccttaaatactgatagtgaattgaatccatagagattctgattttgtgcattccaggtgaggccaagtgtatcaggctgttttaaacctccccagatgattctaatgtgctgctaaggttgagatccccagtcccagccctctcctgaagccaccccactggctggagaagatactgggctgacattgctttttctctgccctgccatggtcactgggtgggcaggcaggcccctgtccagggtagcgtggacactcttccaaggcagcatctacgactctcagctgtcactctcagctctcctccatctaaaacatcttagttttacagttgtgcttttcatatgcctagaaatttctgggctacatttctttcccatatatggacttcatgaccgtctattttcccagaggttttttgcagtttttatgctagtttttgattcaccaatcttttccttctgttaggtttaaagaaaaaagtctacagttccagttagtctacttttgtaacaggacctgacaactccactctacttccaatcctgaaagactacaggaaaaactagcccaagtgactgagctggggggtcccagtcatcggtagcatgggtattttgctttggaatattatcaaatagcagggggaccagcacagtggacttagtgtcaagtctaggatttgattcttagctaacaaaacaagtttcctctctgagttgtgacgattaaatgcaataaaatggaaaagtgcccagcagtgatgggctttcaggagatgccatagacattagctgaatttgaacattttcaacttgaatgggacagaaacattaactggagttgacaggaggatcagcgatgtatctaataagcagcattacaaatagcacaagcttaggtgttcctcagctaccacaccttagtgcttgctcctctgttaggattatctattagactttgctatttacttttattagatttttatattacaagaggggcacataatagagctcatgcaatttggttcatttcagacttgggccagctttaggtgaaagctgctggaactaatttttatagccaggacttcaaatagtgactttgagcctatatcagaacaaaatatcattatccccagccctggctctgacatcagttcttttgaggctgaaagttgccctggggttgtaagatcttacacgaccaataacagaagtcagcagagactcctaggcacagagatgtgataccataattaatattttgatagcattccaaacagcaacagaataatgcctttggccaggaaatcacagatccctacccaccctgttatggtggaactgtgtcccctcaaatgatccccagtagctgtgaatgtgatcttatttggaaatagattcttttgtagatgatcaagttaaggttaagtaaggtcattagggtgggccctaatccactacgactgaacttataaaaagagaaaaaatttggacgtggacatgtgtacgctgagataacattatgtgaagatgaaggcagagattgggagacggaactataagtcagggaacaccaaattgactaatgtccccccagagctaagaagaggccatggaacagcctctccttcacaggtcagaaggaaccaatcctgccaataccttgattcccagaattctgacctccggaactgtgacacaagaaatctgtcagtttaagccaataagtttgaggttctttgttacagtagccctaggaaaccagtacacccccttttctctcactctgccttccaggagaagtgatactatagattgctcaaactcaagggaactccttcagtttttcggttgaaacatgtgaaaaggctgatatgtaaccactatgaccttcagaaggggcagtttcacaggatgtagtcaaatatattttctggtgggtggagctttgtgtgagacataaatcaatctcactgggtagctgtctcaatttccactttcccagttcagtgtgggtggatggggaaggtgctctcaactgggggggtacacaggctgcttttctcattggctttcccttatgcttccgggacattcttcattctgtgtggccagggaacatgtaaactggagacagaacccaaaagctttccctccctaaaaaaggcctaaggtgggatggccagcagggcaggtgaggaccttgctacaaaaattttaggaccgagaaaagtaagtactgctcccccaaaaattcaatctcaaaattaatatttaacttaaatatctaaaatataacatgtccactagccagatcagctgatagtagggcatataaagttatgtttaatgtggtgtattgtgtataacatatgatgtgggtggggtccgcaaaagtaagggtgccaaaggtctgaaacagctctgggcgttggagcaaatggtctttctcctctggctactattgtcttgtacttacaccttcttcctgactgctgtgttctttgacattccaaaatagtaagattagagacctagtgtgggtttgggacagaacaggtagaataaagcaatcccttaccctgcttcatccctggttatatgttgatcttagaaaacgaagagtgctctggacagtgggtggagaagattcaagtacatcttccttgctgacaatatgctctcctatcttttgtaagagtacacaatttaaatttctaaaaattcattacaatacaaagcaaaacaatccctcgtagatttataatcaaactaatatgccacttagaaaagatttgaaataaatgcaaatacctaggtacaatgttttatctttttaatgacacttcaataaacctaattacttttatttttctgaacaaagcaagtggggagaaaaatgtaaagtgtttcttcatacactgcaagtttatgaaattcaagaggtagaaaatgcagcagggttttgaagaagagccttttaaatgaatgtgaggcttggctatccctacacttgggatgcaggtcttctaaatggatgtaagtcttgggtataccttaaagacgatgacagtgaaagtcagcaaatccttccccagtaggctttaactctcttagttaaaaaaaaaaaatacaaaaaaacactaggctgaatgggccatttgtatcatgtagtacgatgactcttatgtatgtacttctatcctgggatgaaagtccttaatgaaggatttgcagattaggttaagagggttatcgttatctaattacacaacaaatccattcatctggcaaatacttagtgaatatctactaagtgccaggcagaatgctaaacaaacttgtccaaaacagccacatgatagcaggggcacgataacagtccctgttgtgcagctcagttgagtaggaggcatctataattccatgtgaggatgagggcagtgcaaggtgctggggggagccctagcatcttcatccattcaggctgctagaacgaactgccacagcctaggtggcttgtaaacaatagaaattcattgctggctgggcgcggtggctcacgactgtaatctcagcactttgggaggctgaggtgggtggatcatgaggtcaagagatagagaccatcctggccaacttggtgaaatcctgtctctactaaaaacacaaaaattagctgggggtgattgtgctcccctgcagtcccagctactcaggaggctaggcagaagaatcacttgaacctgagaggcggaggtttcagtgagctgagatcataccactgcactccagcctggtgacagagcaagactccatcttaaaaaaaaaaaaaaaaaatcattgcccacagatctcaaggctggaatgtccaagatgaaagcaccagcagattcagtgtctaatgagggtcggtttgcccatttcataaatggcacctgctcactgcatcctcacaggatggaagggccaaggcagctctctagggcccctttgataagggctctaatctcattcctgagagctctgccttcatgatttaaccacctctcaaaggactcacctccaaatacataatcacattgatgattacatttctacctgtgaattttggggagatgcattcagaccatagtaagtagggaggggcatttgacttgaatttgagaactgatcaaaaaggctttctgtagaaagtgatagtgaggcctcaaaaacaagaagggcttattcagacaaatgaaataaatgccctggaggcaagaaagcacagcatataagagctgaaagtaatttgatatgaggtaaggatcctccagagagaggaacctggggaggtggggagaagccacatctcgaagggccttgcaagccatatggagaagattcacctctaccctgagggcaataagaagctactaaatgactttaagcagagaatggaaatattcagatgacagcctggctgtttggtgggtggattagagggaaactagaccagtaaagaggctgctgcagtaagcaaggtgggaaatgagaaacattgccactggggacaaaagtgggggactcctaagacagtggcagggagcatcagcaggatttagtgattgggtggaggtgcaagtaagaaaatgaaggttaagagtttagctttgtagagtggtacctctctgtggagcttgagaacttggagagaagaaagctttggtgggaaggggacgattcagttttagacatactgatttggatatacataaagtatagccaagcagagctgcttggaaaacaggtacctgaatctgacgacccctctctcaggcagctctcagggcaagggattccaggaaggagtactgagctgccttgaaggatgaagagtagtgggagggggtgtggcaggaaatgcttggaagctggggaatgatgatgagacttacatgccatgaggaattgcaggtagtacagagggctgtggatggaaggcagggaataattcttgatgggttttgcctgtcatgttttatgcctaaggaatgagatagagctaatataatattttagacaggcgagaaacctgatcatatttgggttttaggaattagactggcactggcatgagtgtgaactggaaatggaaataaatcagaccagttaaaataatctagttttatgcctgtcaaaagatcaagtcctaaactaaggctgaacagagagggtgaggaagaaggaatgaattttagggataccgaggtggcagaaatgacagctatagccatggactaaatgtgggaggtgaggaagatggcaagaatgatattcagagttctggcttggctgatggtggaccatttggtgagatgggcactacccatctcagaggtggaatggcaaggtacaggtctgagaaaagcagggcagatgcgccataaaccctgatctcacaattgactgaaaaatcatgagtcactaagacgttcgaattcttgatccctgcaaggaacagcaattttaattactttcatctgcagtgaagaatttggcatcactttgccctttttgtcaatattaaggcttggaaatcagttctgtttgcaaaactactttatcttttgaaagaaacagatactcaacatgttaaaaatggccaaaatataacttggtatttgcagggatctctctttcccaaataatcagatatctaaaatcttgtgttgaagagaagtacctataatttgcccaagccttcaagatgctatcacatggctgattcctctcattcttcaagtttcagctgagatgaaaatggtcagaaaagcattttctgaacaccttctccaaacaggtcctgttattactatcatggctctacgtcctgtcatccatgccatttcatcagcttaaaagtatatttttatttacatattactctcttcccactatgattataaggtccttcagggttgatagggtttggatctgtgtccctgctcaaatctcctgtgaaattataatctccaatgtggaggtggggctggtgggaggtgactggatcatgggggtggtttctgatggtttaccaccatccccctagtgctgtttcatgagagagttctcaggagatctggttgtttgcaagtgtgtagcacctccctcaccttcctcctgctctgggccatgtaatttgtgcctgcttccccttctgccatgattgaaagtttcccgaggcctccccagaagccaccatgcttcctgtacagcctgcagaaccgtgagccgattaaaccgcttttctttataaattacccagcctcaggtatttctttacggcaatgcaagagtggactgatacaaggtaaagattgtgcctgcttcttttacctgagtatagccagtggcagctttatgccctggcctatcatcaccatcctataaatactaattaagttcacggctaaagaacagtcacgattcctgttctcaaggctctttttagccagtatcatttttatggccatgtcggttgttaaaattcaaagtccttctgtacttaataacctctgctcagagccctggaagtcccccagcccttactcattcttctatttgcccttttcgaggaattctcagaattctcctcaacccacaacttaaggcctaatacctggcccagtgtgccctagttctggtgctgaggactgtgtgtgttggttggtgtctgtgctgtacaggttggtaaatgttttgaaggtcatacctgcctagacttctaatccaaacccagaatctactttctgttgctatataatacatagaaacttccataataatgacatagagtaacataggaaaagatccctattgctaatgatgaacaagttaaattcatattaaagcaaaaccatagcctcagatagggtaaacagatgggcaggtctgtgtgaacgtgtttgtgtcagggttaggagttagggaggtctgtggcaagggaggattgcagaacaatcacctttatgttcttttggattgaagacaaagtttcatctctttcaaggagagagaagagctttattgaaaaaagtcaaacttcaactgcgaatatattccttaagtggagagatcctgggtgagactccatccagaagctggcttaattggactccaactgggcagaatgaattcttaatcagaacatattttatttgcttaaaatgaatattattgcagttacccccgatttatcaacaaagtggccattaacagccatcagtggctgaccttgacagattccattactgaaataatgaaatttgatgggttactattattaagatttgctaatggttttacattgcagagcttgagaccagtgaaacagagctgcttactcaggcaggctgaccacagggaaaatgagagggagggagtaatgaaaagcacagggagcttgatgaaaaatgaatggctcccaggcagaatttccacaaatgaaatgcaaattcagatatatatctcttaatcaccaaactgaaaaggttgattacttaaaattagactcaccagatgtttttgttgtaggcaggaatggaaagctgactaagtgggaaaatacaaatttattctttaaaaggtcctagttatctcataatagctggtaggaaattgaactgaagtcataaacggaaagcagctagattcagaggggaatgaggagaaaagctcagaggcaagaaaaggagaagaaataagacaattctattgtgttagcattcctgatatttgtaaacttgggctgacgtgcaaaagaagtgatttactttttttttcctaaaaattcattggttagcagctttcttctcacataattttagattgtaaacattttacttcccttatcctcagagccattattaatttccattaccttcagacatgacccagctacaagaaacaccaacccaatttcgtttgagtggaaccagctgtgggcaaaggagtaaagttgcttctgggatacagtttgggagacattggaaaggcctgttcttagattgtctccctcaccttcctggttttcccatcaaagatttgtctgtttggatctatcaagcattttgaacttactggcttctgtttaaaatgcaaacacttccgaagaggcaataactgagaacctgttaggcttatcaactaatacctttgcctaaatagagattctgtcaggacaaaagttttgaggagtggattatttcagagcaattagtgtttgggagagggaaaaaggcactcctaagagttggaagagatcatttttacctatcttacaatttccaagaggagggcccttctgtggcttaactagtatttattgccaaaacttcatggattaaaaactcccaaactgaagtcagttttggtttcctcatgcctctctatatggcaaaagaaccctagataatgaggaatattggatgcacatggagataacctccttgtttgtctataagatagaaatagattctgtcttgctattattgcctgtcctttactttctgggtcagtggtccaggatcctgttaatttcttacataacaaattagctgtggacctcaataaccactgtccaagtttgtaaaacagagaacgagatatgagtaagttccttgccagatctattataattaagttactgtaacttctgtaagtgtacttaagcctaacagtcagtacacagcatataggaaatgcatatgtggttttgaaccaatcagcttaagtatattgtacattagaggagataggctcaaagcaagtaattccttttaaaatgtttttatatgcatcacatccataactaagggcctactgtgtggtaggtatcacaatccaggagtgcaaaggtaagaactgtgtaacatatgggcctgttctatggaaatgaatgtattagggaatctgttatattttgctatcaaggttaataaaacaaaaacagaaaaagttagccagggggaaatgtattgtataatccattttgggatagataaaaggtgactttggggaacatagagccccttgccccgcataagaaactccagaaatagaaaagagaaacaggaaaaccaaaactggctggccactcgggagatcacatttgttagtggcttccgctaagtgaactatttgagacaacttataacttatgttgggtcaggtaactctagaagtgccctctagttggtaatagatagcttgtaatatgtctggttcatataataaaaccttatttgaatgccactattgtcagaacatgtagaaagatactatatttgcactacctataaaatggtatttgttctacaaaggtataaaattatagggggataattaaaatgcttagactcttcaggcacttgacagtcatttctgtgtaaatgacttaaatcactaattgtaaaacatttcaatttaatcctcaagatacctcaaggagctccactcgctgatattctttctggtataacactagttaccattctttctggtataacactagttaccatgtgcattggagaataaaaatttctctgaaataaactgcaattgtgactctttaattcagacttattttctcaacaattagtcaaaattagtcaaataaggtgaaagtataaatggttatacaaaactcttaatttcttatgaagactataagggcaattatacatgaaaaataaaaggcttaactctcacttttaaaaataagagaatgcagtttgatagctctgatgcttaaaaaataaaaagggaataagaacaaaagttatcttttcttagagcattttcctttgtcaacttgtaattggcccggtgtggtggctcatacctataaatttcagcactttggaaggctgaggtggaaggattgcttgagcccaggagttcaagaccactctgggcaacatagcagcgcctcatctctacaaaaagtacaaaaattagctgagcgtggtggagtgtgcctgtagtcccagctacttaaggggctgaggcaggaggattgcttgagcccaggagttcaaggctgccgtgagctatgaagtaagctgccactgcactccagcctgggcaccagagtgagactccctcaaaatgaaaaaaaaaaaaaaaaaaagaaaaaaaaaaaagacagtcatatgaaaaaagctcaacatcactgatcatttgaaaatcaaaaccacaatgagataccatctcatgccagtcagaatggtgattattaggaagtaaataacacgctggcaaggttgtggagaaaaaggaacacttatatactgtcggtgggagtgtaaattagttcaaccattgtggaagacagtgtggtggttcctcaaagatctagaggcagaaatatcatttgacccagcaatcccattactgaatatatacccaaaggaatataaattattctgttataaagacacatgcacacatatattcattgcagcactattcacaatagcagagacatggaaacaacataaatatccatcactgatagactggataaagaaaatgtggtacatatataccatagaatactatgcagtcataaaaatgagatcatgtcctttgcagggacatggatggagcctggaggccattatccttagcaaaactaaactatacacatgttctcacatataagtgggagctaaatgatgagaacacatggacacataggggaacaacacacaactagggcctgttggagggtggggcctgggaggaagttagacgatcaggaaaaataaataatgggtactatgcttaatacctgggtgatgaaataatctgtacaacaaacttgtgccatgacacaagtttacctacatgacaaacctgcacaggtacccctgaacttaaaagttcataaaatccttgtaattataaattctttctttggctctttgagatgaaaaatattttaaaaggccctcgcaggtcttacaagccaggagtgtcattttctaggaccaaggagccatctctctgacgtaaaggagacaacacttctatcttgcggcttcggtaagaaggtaggagcctaaacttccgaggatcctcctcctccaacttgcaaaactacttcttgtcattaagatatgagaagtttgtttttccctttataagacactaattagctaacacagatgttcaccccaattaccaggtatatttaggatgaactatgtgaggcacatggtgctgtcaagtccttatgtgaggactagctagttgtttatctagagaatgcctatgtaataggatgcatctgtttggctgtataaaagagtgagattcgtctttgcaatccctcagtggattccctctatgtgtatcatattctagtttagcgtttattcaataataaagctgctttctttctctactatatttgtaaagaggtttttttttaggttggaagatgattttgtctttaaatttacccaacctaacctcatattgattttagatatatttcacgtgctcttaaactatgtccctaaaacccgagcagatgttaacattagctttactgcctatgggttaaccattcatgtcaacactgattctccttcctccggatcttggtgaatcaccctagaacatgttttgccacccttcctcactcacttcctggtattatcactgataatggtctgcagctttaatttaaattagaggattaattttatgatatctcaaataatgtgataacagcaagtagattgtcttaaaagtcatgtgtcagctagctgagaaagactgcaagtgatagggaggaaagaggctgagctgttagggatttaaggtcagtgagtacatgacaaaaaataaaatattacatgcctagaaaggcaggacaaaatgaagcaatgactcaaagttcatcaacagaaaagaatataagagatttcagccttcagtcctagcaacagcctgcaatacaaaacaattctggctctactaggtgaagatgctgacctaaaccagtcctgggtcacctggactgtacttggagcagcaatgtccattggaacgttctgtgacggaagggttccatatctactgcccaatgtactagccaccagccatgtgtgtactgaccactgaaaatgtggctggtgtgacagagcagttgaatgttaaatttaagttgataaaataaaaatgaaatggcaatatatatgactagtggctactctattggacaacacagaactatatgattcaagggaagatgatttttggggtcatttacttaaatattacaaggcttgcgctatttggagagaaatctcctgtgtaggatactgatcagcatttatcactgattggaagatgtacagatactagagttgaagtggtcctagatgttgttggcagtgatgggaacatttgggtgcttgagacgaggtaagcttttctgggttctctccagccatctcatgagacttcttgctgtatttttcacatatttcattattttcaagttctactatctttatcttgctcacatcctgggaatcataagaggattaattcgtgagtttcataaattgttttgtagattaaaattccctattaaaatgtctattactatcagcagtcctgacttggagagattagacttctgacaattcctgtttatagggttcggagcaatgcatctgtgctattagcccaggaggcaggcccacacagactcagttagattaagcaatcagcttcctgataggcttaccgagaaagctgactcgcccttcagcctcagcctggcctcgtggttcctcccttctctgcctgcttcctgtcctagggtctgtcagccactctgcagagctatcctgtactgcctgaggggctgtgcaatcaactcaggcctcaggggagagagcagctgaggaatgtaaatggtgcacagtgtaaacagtaatgcacttgaagtcacaagacctggctttgagtcccagacttgccttgttaattatgaaattctgactaggtacttagtctctttgaaacttacttttctcattcccattcatttaacaaatattgagttaggtactgtgttaggaactggggagtcatcagtgaactagactaaaaacttctaccctcatggaatttacattttcagcaagaggaactgaaaataaacataataaatgctttacataacacatcagaaggtaataagtaggccaggtacggtggctcatgccagtaatcccagaactttgggaggccaaggtgggtggatcacctgaggtcaggagttcgagaccagcctggccaacctggtgaaacatattctctactaaaaatacaaagattagctgggtgtggtggtgggcgcctgtaatcccagttacttgggcagctgaggcaggagaatcgcttgacctgggaggcagaggttgcagtgagtcgagattgcgccactgcactccagcctgggtgacaagagtgaaactctgtctcaaaaagtgataagtgagggagatagataaagcttggtaaactggatggggaatagatgggagacaacatggtttttgtgggggaatcaggataagcctcactgagaaatagacatttgggcaaaagcttgaggaaataaggcaagtacctatctgtgaagaaccgtccaagtttaagtccagacataagacagagaaacctgaaaataaaaactggttgatgaccctcacctagagataagttacccttaaaatgcctactatgtgctaggtgccaaatacttacttacatttaaaggctgacgctgactgatttccttcatcatggaaaatgaaggttatccaaataacttgacaagttaaaagcatctcaggaaagggatcattttcaatttgaatctgtcttgttccactgtttactatgaatttgtagcaatattatgagatagcttggtgcatatgtgtatgtaatatataaaactgttagccaattctgcatgggaatctgagttgctaatttctccagaacatctcttgaaggatttttgaatagtgaataatctttcaagatggagatagtgtctccatctggagcaaaggtcaggtttgtttcctgctcattatgaagatttgggtttgttaagctcggttttctttcctgtatacaatccactgtgtctgtagttgccatatggccctctttacatcaccctgtgaaaactgggacttgtgcaactactgcaagaaagtggcgatactctggctattgtagtgaatctctgatccaagagtctcatgtcttgcagcaagataatgtgttagcctgcaactagaataaaatccaaaacctgcctttaagtcttgacatctatgatttgagatagagatttttttaaagagaactaagtgaactttttgtcctgagtgaagcacaaagtacccacattgtaaagtggaaaatagaatggttcatcaattgtcccagcaccactgcaaagagacagttaagtagctggtttccttaggcaactggaaatctagataatattgtgaatttaattgaccactaatggaagttctctatttttaaacatttttctttccatctttctgaagcgataggaataccttttccctagaaaggtcagacttcaggaagcacataacatttaaataatctgaaagctcagcatccctggatgtgcaaagctgccagagctgggtcagagagtcaagctgaatggaattactgaaggcagctatatggctggaaatgcagtcttaagatgaagtggaaagctaagctctgacagcttggtattgagatttaacatttgcacaaggttgttgaggataaaggcaattgccaagaacaagtaaaactattcagaagttcatagatttgagggggtcattcatacgaccaaaagaaaactccaactcaaggaactgtgtattacttgtgtctaatatttccccaaaatatcattgctaaattttttttcttcaaaattagggaattagcactcttacagatatatcatttttactattaaatatagttctttgaaagaacctactcacgggggtatatatgaaattccctatgttcaactgagtttctattttatcctgtatgcagcatttccattatttgtccttgggcaattcccaaaggaagtctagggcagtttttcatccttgaagcatctaaatgtgctctataaactatattctatattcaccagctgcttatataatgttatttctaaatgtggaacaaaaaagttatttactgccactattggcacacaaattcaatatgtattaaaatattcttattaagaagtgttagaaaaataaaacttcatgaaaatcttttaaaattcccagatatattattaaataataagcaagcaaacagtgactggacttatggtgataaagtagctttacagaatctgaagagactaaaaagggaaattatattagagaaatacaaagtgattgaagtagatacgtcaccaaaagcacaaacaaaaacagaaaaatagataaaccggacttcgtcattattaaaaacctttgtgcatcaaagtatgttaccaagacagtgaaaagacaacctacagaatgagaaaaaatatttgcaagtcctatatttgataagggtttaatgtccagaacataaagaatttctaaaactcaacaaacagataaaacagcccaattaaaaattgggcaaagaatttgaatagggatttcttcaaagaagacattacaaatgaccaataaacatatgaaatgatcaacgtcagtagtcattagggaaatgcaaatcagaatcacaatgagataaccacttctcacatactatgatggctataacaaacacaaggaaaatattgttgaggacttggagaaatcagaacccttgtacgttgatggcggaagtgtaaaatcacacagatgctgtagaagacagtttgatagttcatcaaaaagttaaagatagaactatcatatgacccagtaattccactcctaggtatattccccaaagaattaaaaacaggttattaatatgccaatgctctgaattgtaacattattcagaatagtcaaaagcagaaatccacatatccatcaacagatgaatgaataaaatgaggtacatatatatataatgaaatattattcagccatagaaaatgaagttctgatatgtactatactacagaccctgaaaacagtatgctaagtgaaataagccagacagaaagagaataaatgttgtataattgcacttgtataaaatatctggaacagatgaattaagagacagcagattagaggttaccagggagttgggttggaaggagtggggagttattgcttaatggttacagaatttgtttgtgaaggcgaaaaaatttggaaatagatagtggtgatggtagcacaagattgtgaatgtaatttatgccactaaatcattacacttagaaatggttaaaatggcaaattctctattatatattttactgcataaagtacatgcctttgtgacttttaaaaatatgaattctaaactggtcaaatatatataatggattttttaaaacaagaaagtgaagaaattattggggtctaagtaaacatacctgagataattacaggcaattgaaactaaaaggacagatatagactactgtagggatagaataaaataaatcagatcaaatgctaaactactgtcttgaacatgctactttatttgtaatggtcaagactagaaacagaattggaagaatagttaacagattgtggtataccaatatgagagaataacttgcaggtattaaagtcattataaagcccatgtagaaaaacaaattgacaatacaatgttatgtgaaaggatcagaatataaaacagtatattacattattgcaactttgctaagatacattgtatgtggcagacaaaatatgaaaacagttgtgctaggattaaaacatttctactactgttgctttattgttaattcaggtttttagaaaaaaggatacatgaaaacattggtttaataccttgcatctctattagtaattatctattgtgcaaaataactttggagattcaggctagcttctctttactctagagttgtatccatcatatactgttttactatgcagatttgttatgtctaaattgggctatgattagtgacattagagctaagccagggatttgaagaagttaaaagctaaagaaattccacaatgagttttgcttgggatctcactaaatattcttatttaactccaatatttcaagattcaatatatatataactaagattatatagtttgaaattagcttaggaattcagtagtccaagttcttttaacaaaggaaaaaactgaggtatacagcccatgtgctgacaaaagccagacagtagccaagcttgcctgtcttaatactctgctcattccattatgccagagcaacttctcatctatcctcaaactccacattaccatgtaatatagacacgtgcctgcatgagcttggtgctggaagacataacttcaaaaggatgctagcttattgctgtttacttgtactgaattaactgaacccattatctctttgacattgtgagaattacttcaacttatcagtgcaacctgattcagatttcttattccatccttgtgaaaaagctattccaaatccataaattcagtgggtcagttttgacctgaaaaagtgaaatcagtaatgaaaatattgcctccttttatgattattcaattctacttgaagcaagaggctggattgaaaaacaacctcttttggtccatcagttctcttttggtctaattttattgccaaactattacaggctgctgaaccactgatcaggctgctaactaatcagttttctaccctatactcatccatagtggaaaaagaaaataaacaagcaattcagaaaatacattatttagcattactctttcaatagggtctatgacttagtttattacaccaagaaccaacccaatttcaaataattacaaagtgttagtaaactctccaggtaggcacacagagacatgagttgcagataacgctgcatgcattggtcaggccagtaagaggtttcagtatctttccctgcatttttgacacctaactggctgagtatggctctgcgggtcatgtggaaacttagaagtagaatctctgccaacagaacaaaagcatctttgttcagaggcttgctgacaattttaggtgttgaaacccaacagtagaaaatggaattatagagctggaaagaattatcaaaatgtaatttaattctagacatatcctgcataagacatgattttctgaactatttcagaagagtgccagggaaattactttagtcgtatcttttatttttcctctttaaattccgacaaatatcttattaatggacagtgatatctttacaataccatggtgttctttcaaatatgagaaggtacttttttactctgaccaatttggaatgaaaactacacttaaatgtagactttaaatcaaagataatgtgagagaaaattataagaatcaaagtgatatgcaccagcttaaggaaatcagaattggttatcaatggccagttctagcacttattaagcacctgttttgctagtggtgaggaactcaaagacaaataagacatagcccctgtccttgagaggttataaaatctagcatgctgtattgcatggtttatttgaccactctgtatattacaaatggaagtgctaatattaacaagcgtatgtgcaaaaaggatatatgaaaacattagtttaatactttgcatctcaattagtaattattatgcaaaataactttggagtttcaggctagcttctctttattctagagttgtatcaattatatactattttattatatagatttgttacgtctaaattggactacaattagttatgatttgttatgtctgtttatttgaccactctgtatactactaatggaagtgctaacattaacaagtgtacgtgcaaaaaggacacatgaaaacattggtttaataccttgtgtctctgttagtttaataccttgcatctctatatacaaaagccccgaaatttaaaaaagtgtacatgcagtataattcatgagtagatgttaaaagtctgctccaatcctaaactgatagtgtaggcagtgcttctcagagtgtcccaatttttggacttcccattagttcctactcagattctctgggaatgggccctgagaatatgtatttcccagtaattattattattattattttgagatggagttttgctcttgttgcccaggctggagtgcaatggcgtgatctcagctcactgaaacctccgcctcccggttcaagtgattcttctgcctcagtagctgggcgtgagccaccgcacccggccactgccattgtttcctgactttgcctagaaaagttagccttcagagacaaattctcattcaaaggtgaaatgatcttcagttatgagtgattatttttgcatctattttactttcttttttttttttaaccttggaaccagtttattctggtgctaagaagaactgtaaaatagttaaaatgtcctatcaagtaattcactgattacatagacaccacttttgttttttattccattttttgttttaactcatgtggtagtgatatttaatactttctgatcaaataggttcaaagcgaatctttaaatttcaaatttctttttttaattgtgataatacattttatttaacacagtatatccaaaacattcccaactgtaatataaaatttattattattattattattattattattattattatactttaagttttagggtatatgtgcacaatgtgccggttagttacatatgtatacatgtgccatgttggtgtgctgcacccattaactcgtcatttacattaggtgtatctcctaatgctatccctaccccctccccctaccccacaacagtccccagagtgtgatgttccccttcctgtgtccatgtgttctcattgttcaattcccacctatgagtgagaatatgcggtgtttggttttttgtccttgcgatagtttactgagaatgatgatttccaatttactttcaaacttgtctgagaatggttactctggatgttcagaaacatttcactttcacagttcagtcatattcttgtctttcattcaaatgtccgcaaaaataggcaggtgagcaagtgctggctaaggcagttcagtgaggaaagggctagaggggaggagttctgaaggccataaccagaatctaaaagaagttcattcccctgaggaaaattccctattaacactgttcccataattgctttcacttttatgagaaatgtaaacagtcagaaatgaaacctcattaatataatgaaaatatttcttgctggaattaataaaactctctcctgctgagtttaaagcaccaagttattgaaaagacaaaagtgtgactttcagcttttgcctgacaattggaacgtgaaattctcatggtatgtctcttattcttagcttcggtcttgccaaaactatttccatggaaacagacatcaaatctgaaaatactgaaaaagctactatggggatgatcatctaaactcatttgctatacttcgccaagtaaggtcccgagtgtaaaaaggcgaacacaggctggcatcctagtgtaaaaatgactttgctatcagggaaaaaccacaagggcctcttaggggaccatgtttcttccttctatttctctatccctcttttgtttctttttccctcccttctcttctcacttattcagtcattccttcacccaatataattgagttcctatttatggttaaatatatgtacacatatttgttttctcccatgtaagtcaggaacactgatgcatggttttcagagagaaaccaatagacagatactgtcttgcattgtatctaggaagcatgtctgtttaaacagatgcaaacaatggaagggcaaggttggtgtcttgccatcactggcatctaacacaaaatggctccataaacattaggaatcctgatgcctgaacagaatggttggagccatagtagaactgttgaggactggtataggaaatgtgttggagagttagtgtagctgagaaacacaaaaggaacctcgtttcctttgagtgaagaagccacaggtgtgtggttggggaattcagaagcctgtgcctaaggtggaaatagtagacttaaaaccacagtgcttgaagcacagccaataaatgaggatcaactctctttattccagacaggattgaacatcttctctcaaatgaaacaactttaatacaaaattacccttatcatagaaagatggattaattggtctattagaaaaataaagaacacccctgagtagacagacctttgatttctgtagcaactgggtcatgtccaaaagttctttattaaatgtatagcctgagtggtttccttgaataatatgtcgagtgggaattaattgcacaatgtattaattatgggaatatagcctacaaatgtagtcagtcatgtaaacctttatagttgttcatctgggattttaaaaactttcaaatgtgaaaaggaatcatgaatctacccccacataaaatagggaatggtaggagaaaaatcaattcccatttttaaagaccttttaaaaagtggagaatggcaagcattcatgattgttaccctaaaggttcttattgacacaggctaatataaattgagcaaaaaggttttgttcatctttacatctcaccatagctaatggttctaactcatgaaatcagttattaataattaaaattaattttaaaagacagtagataattgactttgaagacatcactttttaaagtgccaccatacttcatgtttctcagctcctcctggttaaaacaaaagctattatagacccttaaacagggccctagagtgtgaggaaaggtcagaaaaatgctgccttatgaaatgagagccaaggaggatcatcataaaatggatgaaaatgttcacctacagaaatcttcctagaagtgactcttcagaagaaaggttttgaaaatgtttccgattaaaaacatagctccctgttcatccaggactccaaagtggctctccaaaagtaatccaaaacaaatacccacagcacaactagagaaagcaggtgctaattttggaactgtaatagtaatatatgttataacagacaattttgatgattgacaagagatactgaaaaagatgagttcaacagctaaaaagtcttcagcattctttccaggggagaagacattctgattttagaaaactgatcttgcttatctaatcacaaatatccctacagtggaaaatggtgattcatcaatgttatagagttataaaaatatcctttaaagaacatcttagttcatatatctcaatctgttgcttatcgagccatatcataacatctttcttccatattattctatcttctttgaaagttctggcctattctccatttctactgttgaaattctgcccatccttcaaggttcaactcaagcatctccctcttgacacaaccatctctgatccccaatttttgccagagttctctgcattttttttataatggcagattctgctttctcagaattagcagtttcttcattcaattgtaaggcatttgctgtgtgcttgtattttgattcatatatatatatatatatatttttttttttttttttttttttgagacagagtcttgctctgtcgcacaggctggagtgcagtggcgcaatctcagctcactgcaagctccgcctcccgggttcacgccattcttctgcctcagcctcctgagtagctgggactacaagcgcctgccaccacgccctactaattttcttttttttttatttttagtagagactgggtttcactgtgttagccaggatggtctcgatctcctgaccttgtgatccatccgcctcggcctcccaaagtgctgggattacaggcgtgagccaccgtgcctgtccttgattcatatttttaacaaaagttcgtgagaatatatctgtcaaactcttttgctagatgctttatgttcactgaatcctcactgtgtcccccacatgcttgtatagtcccttatccactgtggacccttactaactttgcattgccatttaatatgaccagctgagaagattctcttatcaggaaggtgtgtccctgcaggtgaatggatccaggaaaatgggttcctattacattcattttaaataagtgagcttattggaatttgagtcatataagccaacttcccagagtgcaatcatctctggatgaaggggaaaacatagtatatctaaacttacaagttgatgcctagactgtggaatgtggggactccactaatgagtagctgttatgatgagacccatgaggcctctagaagctatactgtaccctttcttatatatattttccaaaagcatccaatttaaagaacaaaaaaactgccctgagatgatatgtgtattccaatacggcagaactcggcttagatgagaacgattcttgcacgctttccaaagaaatctcaaaatctgaaacgaaagctcaccaacttgattggggagaaattcaaaataaatcaacagctcaacagctcaacagctctttttttaagcagaccttactaactaggccttcataattacaacacagtgatattaagtagacaaacaaaagtagtttattcttatataaaggttaggctttcatttaaagtactatatggggaaagcaatctaaaacttttgaaaccaagggcacaaggaaacaaatttttttcaaagtgcttgcagagtcagactccagaaattaatttttatatgcaggtgtacctggataggcattttctattacatagtttgtactcaagatgaagtacattttctgctttgctttccattccttgcactctgaaaatttgtgacctagtaggggaataaactaatgattataatcgaatatgtgaaaatatagagatatggaggggttttggaagaatcaaagcagggcaagtacctcatttatagagggaaggggaaatgtgaaggcttcctggaagaggtgatgccaaaatcataggaaagtagaaaagtagaaggcagctaggcaagaggatgagaaggcttttcaagcagaagattaaaaaatgaaagtgtgggagtgaaatgacatgagaatgatgggaaatttattgcagctggagaataaaagatgaggcaatatacagtaagagatgaaatagaggtatggaccaggtccatatttatggggactttatgcctttcatttaaggatccgtactttatggggcaagagagacactcaagagtttcagtcaggagagcaatttagttaaacctgtttcatatggctcacttcagtggcaaggtagagaatgagagcaacaaccctgtggacagggaaatgtttgcattagcaccagagagagatgatgagggctgactgggaggagaaaactgatctaggaaacagtgagcaagtaaaaacaaaagaaccactcaactgcttgcatgtggagcttaggaggaggagaggaattctgtgagtctaatgggctgagtagatgttgatggcagatgctaagacagccttcaggagaaacaggtagacaatgagtagagcttttcacctgagaagtgtgggggacttctggctataagcagccacagggtacttggatgccgggggttgaagccctgggaagcacttcatgctgggatgtggattattaagcagtttgtcagtgttctaatagctgaacccacgaaaagaaaaggacccagcagaagcaagaataaaaaatgagaaggtagagaatgggtctctggagaatattaccatttaaggaagaggagaaaaggagtctgcaaaagccacagaggaagaagatctagggagtgggaaggagctgaggaagaagacagatgtgaagaaatcagtccacagaatcaaacaattgcattaaagagtaacactagatgagtatgtgcatatatgtgtatgtatacacatatgattctgtttttgtggatcaagatagtatctgagcacaagtttatactgcctcacccctaaaattctatttaatgatacaaaagaattagaagaaaaaaatcagaattactgaaaagaaaatgtcattttattagtgttttttaaatgatggaagaatttctggaagacagcagatgggatctggtttagagggaaacagaacttgaagaaaggacaaaaacaaatataagaaactgcagcaaatgtcagcagggttttgaggaaactgcatgaaatgcaggataaaaggatatacacatggatgggaattaaggggcattctccaagggctgaaatctgagggagctttgcttggcagtgctcctctcctgcctatgctctgtattggggaggaacagcacagttcaaggttaacacaagagctgtggctgctgatccagagaggcagagagggatgaaggataacttcactttgtattctctatagtcctgagctgtttctttcatgttgagaatgtatttgtgtattacctgaatgaattgttgaaatagaaatagtctttcggattcaactggaaatgcagaagggcttggtgaccttgacaagaacaataaaagggaaggaggctgcagccaatgttgctttgcgacatgaatgaaaggtgacaaaatagaaaaagcaagggtaaaatcttggggaaattaacataagttggagagagatggagagaaatcaaattcttgggaaggacaggaggtagagacaggaagtacagaagatcaggggtacaattggaagatgggagtagaaaaaaacaattgtgcatgatggtcttttcttggggaagaatgggacatgattatctgccttagacagtggcaatcaaaggctgtaaaaaggacctaaacagaaaaatctgaaaaaatccactacctggcacagtggctcatgcctgttatcccaacactttgaaaggctgaagtgggaagattgcttgagccaggagttcaagatcagcctgggcaacacattgaaagcccatctttacaaaaaatacaaaaattagccaggtgtggtgacatgcacctatattcccagctactcagaaggctgaggtgggaggatcgcttgagcatgggaggctgaggctgcagtgagccatgatcacacccctgcactccagcctaggtgacagagtgagaccctgtatcaaaaacaaaaaaaaatccaagaacaaattaaaggactgatagcaatgaacaagaggatctagctgaggttaaaaaccacagataggtggtgtgcccaattcgcagagtaaaattttctccagcaggtctgagttacttgagtgtagcaactgtaaaggctggtttgtcagagccatccaggttgggttttggttaggccaatgaaggagtaggatactaggacacagaggatgctggtgacaataaactgatcagaagatccaccttagctccttgcatggtgacgattcctatctcttagcccagaaaagactgatctggagagagtggaagcctcaagagcatacaggatcctgacgcagcccaagggcagagggtgggcatgaaggggcagcatgcagatgttattcctctgctttaaatagccagaagcaacacaagtaccctgtcccttctcttcttcttagaaagaatatttagcaaaagaataaagaaattcatagtccataagccaggccaaatcaacagactaacaaaaaatgaagcacttctgaccgggcatggtggctcacacctataatccctgcactttgggaggccgaggcaggcggatctcctgaggtcaggagatcgagactagcctgactaacatggtgaaaccccgtctccaataaaaatagaaaaattagctgggtgtggtggcgggcacctgtaatcccagctactcaggaggctgaggcaggagaatcacttgatcctgggaggcagaggttgcggtgagccaaaatggtgccactgcactccagcctgggtgacagagggagactctgtctcaaataaaaaagaaaaaaaaagaaggcacctctttctttcttatgacctgatcgtttcttaattattctcaccagtttccagtggccatggatcatctatgctgtgctaagtgctgttttattgagcatgttttcccaaagatgaggctgaagtctgccatgcagagagaagtcagctgccactctggcaggctctcagctgcctgggtcattaaatgacttcttatccatgggttaatgtcccgaaggacaaccgaggacatgtctttcaagagcagaggttttcgtgatattttaccgtattgtgcttctaagtatgagacaactggccaggcaaggagatgtccctaaattctcttgcatctgtgggcagaggaggggaagggtcactgcactcagggacaagagaaggggtgggccaagtggtggccctgcggatcctttgtttcagggtagtgacaagcatagatggccacttgacacttgacagctctccagcactgccatactctagagacagtagcactttctctcaacatggctatgaacatctctgttcctggatgccaagccactcagctgcaggctggggcagtgcctggatctctctctggacctctggggagggaaatgaagtatggcaggaacaaaaataaagatacaacaaatggaggcaatttcacttcttccccctaggagagaaagtgaaaagatagagaaaccaaaggagacttggactaattcaagtttccgtttgtattctggtagatgctaacttaccatatgatctcccagaagtggaagtgaggacaggtaacccaaagccctttctgtcctggttgcctgaatagtctctgacatgtacttcttaggctgactaatagccgtataaaggagttgggcataaacctggagggtcccaggagagacaatctcaagtggattcctcagatagtttgtttcaggctgtggggctgggaatgtcctccagtgtaaaggctgacagaacaccatctggttttgagtctggtttactcagttgatttattttttcaagcattttttttccagaagatacggtatcataggaaaatatattttgctgtcattcctcttggacctaaatgagcatgctattttttcaacctaagtgcttagattttatgtagttacatttgcttgtatacattcacttcattccatatagaatttgaggttgctcataaaaaaagaagtaaaaaataagaccaaaaaaagtgcaaaaagtatgccagtcaaaaggtctagaaagtagatacatgaagttacatgcaattccaagtatagtagtttttgggaaattagaggctgagttttgaaactcacaagcaagtgaaaatggtcagggaagttaaaaaaaaaagagaaagtactaaatcagagacaataaaaaaatccttaattaaaagtatgttgtggtgaacgactagacagatcagtagaaacagtcaataaacacctaaatacacatggaatgcagtagatggcaaaggtggtatatgaagtctatggggaaacaaatgatgctgggacaataggttgccatgcagaaaaagataaaattagatcacgtgttaatttctaaatggcccaaagacttaaatttataaaacaaaaccataaaagtaatgggaggaaacatttaactttatagtggaaaaggcttttgtagcaatgattcaaaattcagaagccataagagaaaggaacattaataaatgagactccataaatccatgtggaaaaaaacaagtaatgtcaagtgacaagtaacaaactgggaatatacaggtaagatgtgataacacaaagagcttaatcccctaatttaccaattaggaaaaagccaagacaagagttcaaattatgttgaaaacttaattaacacttatatgacaaacattacatttactcaatctttaacctcataaagacagaaaataaattagcatctattttcttttctcacatggctaattagtatatgaaatagaatccaagagagatccaccatgcaaacagaaaccataatgtaggttctgttaccatctccattttatcaccaggaacctgagacacagagaggtgaagtaacttgcccaaggtcacacagcttagaagggacagagccagtattcaaatccagatagtgtggctccagacattttgcttatattcaccaagtcctacagcaaaaaccatgggcagccaattatagaaaataaaaacataacatgaagcgatgctaaaacccccatatactaaatcaacacaaaactacaatgagattttatcattttctctgtccttcaaagcttcctgaaacatctgcactgtctaggaaggcagctatttgagctgcatgaaggcaagaggttaggtccaggaaggttaggattctatgtaaggtgtcacagcttgaggggaatggccccaaataaatgtaacccagcttgcctttcctcccattacaaaagtaataatgcagaaaatacatgattatgtttatccttgagggaaaaaaatctatttagactgacggtacttcaaaattaccccataaactgcaaatatatttctgaaatgaaataacatctggaaaaggaatttaaagtggtatctttggttgcctgtcagaatacggcaatgtgagaatagtcattttcaccttttctgagatatgtctttgctaaagacaggaaataaagtagcttctattttctcttctcatggcattggcagatggaaaaaggatacatcatgaagggtccatgagaaaagaaaccatcctgaggaaagggtttgctcattttatacgttgcggtgaagtcacagttactgctgatcatgggaagtaggtttataaagggaaaatgaaatccatagagaatactaggatcactctctctccaccccgcaggattattcttaatccaatgcttcaatctcctgtcattgctgctttactcagaagctcccacacagaaaacacaatgatttgcaattatgttccttttcctcagaattagatggaatccttcgcaagcagtgaagtgaccacactgataatggtgagcaaggggaaagcagcagtacatttcaggagtactgagtgcaggaaaacttgactaatctatgatgtggttaccgaggtgaaaatgtgtcagatccttgctaactttgaaagttggccgcctcatccaagaagctgtctttgacccatgatgcagttataacagctgcattatggatcatctgaaacactttggaataaaaatatttgtgacaggccgggtgaagtggctcacgcctgtaatcccagcactttgggaggccaaggcctctacttggtatggagggcaatttaaaactttcaaattgtctacttcttgaattttccatttaacaatttcagactgtggttaactggataaataaaacaatggaaagggaaactgtggataaatggaaacaactgtagtctcaacttaatatttttaagatcttcaaaatattctgcaatttagagaaaagtgagatatctaaacaaatccaaggtgggcggatcacgaggtcaggacatcaagaccatcctggctaacacggtgaaaacccatctctactaaaaatacaaaaaattagctgggagtggtggtgcatacctgtagtcccagatactcaggaggctgagccaggagaatggcgtgaacctgggaggcggagctcgcagtgagccatgattgcaccactgcactccagcctgggcaacagagcaagactctgtctcaagataaaaacagaacaaaacaaaactgtgacaaaactatacagaaatgcttaaggaaaaagatgacaatcctgccattctttctaatttaatcatcttgataagtgtgaagtcttttgacagattctcagcacttgtgtgtgtatttgtgtgtgtatgtatacatatatatatatatctccacatattatcactatattatcattagtttaccagaatgagctcacaccatgcataccactccaaaacttgcttcttgcatttaacattatgaacattccttcacttaaatatcaaatacagtggtccccccttgtctgagggccatacattccaagacctccagtagatgcctgaaaccaaggatactaaacttgatatagactgtttttttttcctgtatatgcgtacctatgataaaacttaatttataaagaaagcacagtaagagattagcagcagtaagaattaaagtattagtaaatgattgagtaaaataaagatgactggactacaagcactatgatgccatggcagttgatcagatgactgagatggctacaaagtgactcacaggtggatagcatctgcagtgtggatatgctggacaaagggataattcacattctgggtaatacgaggcaggatggcgggagagtttatcactctacttggtatggagggcgatttaaaactttcaaattgtctatttcttgaattttccatttaacaatttcagactgtggttaactgggtaaataaaactatggaaagggaaactggataatggaaacaactgtagtctcaacttaatatttttaagatcttcaaaatattctgcaatttagagaaaagtgacatatctaaacataatccaacctttccatttctttctgaagaaattgctgcattaaaaatcattacatgtgcttttgtttttctatagaatagattctctcaagtggaattggtaggtcaagttttaatagcttttgctagatggcccaagaacaaataattcacatttccacaagcagggttttgagagagtgcaagtggtgccatattcagggcagcactggctgtcttcactaacttcattttgccaattggataagtgaaagacgttactgcattgttttagattatattgccatgactgtttaagaggctaaacatgttaaataagttttattgtccatttcaagttatgtttctgtgaattgcctgaaattttagtttgcttattctctctgttagattgtttccttttcctctttttaaatatgttgctatttgtattttaaggttattaacccttggtctgccaatcatatacattgcaaatatttttcgtttaactttgcttacactgattttagccgtatcaaacttatataactgtttatgtatatattcttctttatggcatctgcattttttgacttgcttttaaagatctattctgccactaggttatttagaaattattggaaaacttgtgaattgggactcagggtaatgaggaaataacttaatgagattatttattttagatatattaatagaaataacgtgatgatttgaaatgggactgtaatcataagagcaatggaagagtcccataacaattcaaactaaccgggttggaggaaggaaattaagatattgtgcaagtcagtaaatagttcatttaaaaatgagctattaaaatataaatataagatggaagggctaaaactgatgctgattgtcacaaatgtgggcaggtcaaatttcaatattaaaaaggcaaagactaacagattttgttaaataaatctatccatatgttacttgtgaaaatgcacataaagcaaagctacaaaaacatattaaaaatgaaaaggtgagaaaatagcctggggagagtcaaacaaaaaagatagagtaatattagtaccacataaagcagaattcaaggtcccaaacctgtccttggggtcagggagagaaaaagcaattggtgagagggtaccaaggtagccaggatgttaagaagttaagattctggagtgaagggaagagcaagaaagcaaggtaatactatgagctacctttctactcaggcagttgccagtttgttaaaggaacagattgagagaccgaatagctaaagagagttagcagtagtcttacgatgttgaggatatgaaacttgaagctcagagctcctcaaaatggagaacacgtcaggctttcatctgggatcatgaaaaaatacatcctaggtataaaggcaaactagaaatagactggcttttataagaaccttgccttaaataaactcaatcccttattggattaaggggaactgtgcttactttaactgctgttaatgctaaaagactccactctggagaaaggcagtatcaacaaaacacccaaacattttatttcagtgtccagtattcaattaaaaagaattaccaggcggccaggcgcagtggctcatgcctgtaatcccggcactttgggatgccgaggcgggcggatcatgaggtcagtagatcgagaccatcctggctaacatggtgaaaccccatctctactaaaaatacaaaaaaaaatttagccgggtgtggtggcgggcgcctgtagtcccagctacttgggaggctgaggcaggagaatggcgtgaacccaggaggtggagcttgcagtgagccgagatcgcgccactgcactccagcgggggcgacagagtgagactctgtctcaaaaaaaaaaaaaaaaaattatcaggcatacacagtactcaattaaaaaaattaccagacatatcaacagacagaatgaagagaaaaacaaccccaaaactcagaaaagagaaatccctaggtaatcccacaacccagaaaagagagatccagataacttgtgattaatatttaagaaaatagatgaaaacatggagaattattctaaaaacctggaatttataaagaattaaatgaaaaaatctagaactaaaagtgtaggaattaaaattaagaaaacaagagatgggtcttaggcagattagaagtagctgatgagaggactagtaacagaagaagaaaagtcagtaaagctatctcaagaaataaaaggagaaaaatgtacaaaatgtagaagtgtttaacactgcatgttctcactaatatgtgggagctgaatcgtgagaacacgtggacacatggtggggatcaacacacactggggcctgttggtggggggaggtgggagggagagcatcaggaagaataactaatggatgctgggcttaatacctgggtaatgggatgatctgtgcagcaaaccaccatggcacacgtttacccatgtaacaaacctgcacatcctgcacatgtacccctgaacttaaaagttgaagaacaaagcaaaaaaaaaaatgtagaagtgcttgagttataaagaacttaggtaaaaggtttagcatacatgagattggagtcccagacatgaggaagagagagaatggggcagaagcaatatttgaaaagatggtgaccaagagttttgtcaaagtggccaaagtcacaagtttaagaatcagtacatacaccatgcaggataaaaacagaaactaattcacaactaagtacatcatgataaagttgctaaaatagagacaaaacattctgaagcagcagggcgtggcacaaggtgatgtttctgaaggaataaaaataagactgacagctggattcttacaaacaaaaaatataagcctggaatgttggatttgccacctatgaagtgctgaaaaaaaaaaaagatgactgtcaacctagaattctatactgaacaaaaatgtgtttgaaatgaaagcaaaataaagatgcttaggataagaaaaacagaacaaacgacatgatattctagaggaaattcttcaggaatgaggaacccaggcaaaatcatgaaaatgaagaaagcaataaacagcaacaggggttaatatgtgagaaatagtgaatagaatggctataatgatgtcttatgggtttaaaaaagacatttagtaaatagggaaaaacccaaaagacaacagggatagatggagctaaaaggttctaaagtttttgcactatccgagaagtgttacaagtaataatttgttttagactctaaggtcaataaggaatgttgtaatcattgaagtaatttaaaacaatggataacaagctcataaaggggaatgatgaattgacaattcttgattagtccaaaagaaggtaagaatgaaaagaaactagaatatagaacaaataagaaaatagcaaattgtaagataacagatttaaacccaaatatgagttaacattatatgtaaaaggactaaatactccaactaaaagacaaagatggggttaaaaacaaaactttatatgctgcttacaggctaacactttaaagtcacaaaaggtttgaaagtaacaggatgaaataagatatatccaaaaatgataatcaaaagaaaattaacgtagctatactaagatcaaatagattttaaatcaagaagcatcactagatataaagtgggacagttaatgataaaagaatcaatgtaaaggttaaaatttgtatgcagctaataacccatgaaggtatagaaaatgtaaatgcaataactatagaagttagaaatgtaacttaaaatactatttaaaaaggagccaggatgaagagatttggaaccaagttctacataacctctcaaaaacatgtaatttctacttaaagacttcaagacttagggaaagtggaaacttctctatcatttaataaagctagaaaaagaaaacttgtaagaatcataaaccaaccaactttgtcatacaaactcaatattccaggaatgtaagacagtattacatttagaaatttaccaagagagtgaacatatcaatagcttgaagagaaaatatcaattgagtctaaaaaaagctttagttactagtagaagcaaacaagttagatcatattttaaaattccagctagactaaggatctaaattaaaagaaaccacacacaaagcaaacaaaaaactaaacccaaagcaaaataatcaaaacagaaacactagaagaaaactcaagagaatatttgtgctgagtctctgtaggtccttcattagatctgcctttttcctttttacattttccgcttgccccctcctcagggcacacacctcagacttctagtatagattctatgtaacttttttttattcttttgtttccttgtcttctcctaccttactgtgagagatctttgaatgcatatctttttcatcttggtctatacagtgccaaacacatagtagatgcacattacaagactggtcaaatgtgggggcagtggctcatgactgtaatcccagcactttgggaggccaaggtagggggatcacctgaggtcgggagttcgagactagcctgaccaacatggagaaaccttgtctctactaaaaatgcaaaattagccgggcgtggtggcacatgcctgtaatcccagctactcaggaggctgaggcaggagaatagcttgaatgcgggaggcggaggttgcggtgagccaagatagcaccattgcactccagcctgggcaacaagagcgaaacttcatctcaaaaagactggccaagtggatggatgaatgatccctgcctggcaccaccacaatcattccagcctgcctgcctcctgtggtgatagtctgcctctggctctttctggctatcttttgtgcagtggaaagagcatgggctttggactcagattgacccatattgactcctgattataagtgatatcatcctgtgcaactgagttctctgaagctgattttctttaaggggctttgtatactactgggtccgtactcagtgctcagaaactgttaccttactactggtgttatcatgaagcctgaatgagatgggggagtcagtgtggctgaggaaaagatggttgaccttcccagcatttgtctcaccaatggcacagtatattggggtaaaactatggacagtgtatcagggtaaaaataaatagcttcatttgctccctctgcattaatcttgattctcctacttatcacgctgaccaccctgaaaacctgtctcagtggtcttcaactctgactgccccttagaatcacctggcctcaccctaggcaattaaatcagaatgttcccaggggcattttatgtgtaattgggattgagtggttactggcccttcactttcttgctcttagtagaatgagtccaacttgcacagtcccagaaactacaagcattttctaggagcaaaaactgtttcctaaggaaggtacagaaagaacagggcatggtgctggaagtttagagtcctagtcctgctgcaagttggagacatgatccagtaagccacaatacctctgtattctggtttcctcatttatcaaataagcaccatagaatcttctatctcaaacggtaatgggaaatttaaaataggaagtaggtaagactttttaaacatttgaaagtgacacaagtgtgatttgttagtgtttccatcagatgttcccatcagaattcaataaaatccttgttgtgctacttactggctgtggggctttgcacagctcattttgctttttgaatcccagtttttcctcatctataagatggagctacttactcttcaaattgcataatagttcccattgctagcagcaaagaaaacaatgggaactaaaatacacaagatatagtattattgtgttggctcttattattggtactattattccaatgctgtggataagctcactcaagcccttgatttcaagcggtggaatctcatagtctctcatattagcggatgctggcactggcgtggccataaacaggtgcaacactcctgcctgctaagcttttggattttaaaatgaatgtcagagaatctttggttaccaaccaagctgctgaggttgacaggtacaattcacttcactgcctgagacccgcccccttagcttccattacctgggcttttctgactattaggtgtgtgacagaagatcaatactggcgagagatgaatatatgtaatcaacctaacagaagcaagttgaaatcctttggtgtgtggtatcataaaaggaggaaggtcaatagggacactgggtcggactgaaaagcagccttgccccaaagcaaatcctggcactttcctctggcccaccttttccctccaagctacagcacatggtacctttctctagagcccagaggctttatgttctctagcaaagtggtctgcatccttacgttgatcataagttcagtgattataaaagttgaggtctttgggaaacccaagaattagagtcgtggacttgaaagtaagaaatagggaaaacagcacagttatttctgactttttggctctactgtttatagttttgcctgtgcaaagcaatacaaattcatgttgtcagccagtgacataaacagatttttctttcctgaagcgaatctgataattatgatgttgtaacatatcttgcaccacccaaaacagtagattgaggatgtcaggtttcagtacaacaaaatggaacaagtcttttcagaaagcacgaactgtcatttcaaatgagactctgaaatatgttgccacttacctactgatatggtccaaacagcaatgattttcagaaatgccttagttctggagttgaagcggctgtggtggatgggattctggatggcgacgtagcggtccagcgagatggcgcagaggtgcatgatggaggccgtggagaagagcacgtccaggtaaatccagactgcacaaagcttgctcggcagaggccaccggtaccctatgaggcagaaggttggtgtcagtgagcaaccctgtgcctcctggagcacatgtatccctatcctatgacaatttccagctctgggacaggcacaggtggtggcaaagggcaacacaatatatttttagtatttgaaaaaagcccactggcaactgtacttaactatgataagctagcactggctgatgaatgcagggtttgaaaatttctagtgtctggagttatgtgagtgtggcacggtaagcttggatggtctctatttgggggttctctttcttcccccttacgcctggcaaaacatttcttttgttaatggcttatgtcaaaatttgtgttttggctcctcttctggagcacctctcacactgtactgtcaggatttagtcacatatttctctggattgtatttccctaaggttagtctcacctcttagtcattattataaccatccagtcccatacagtgatggcaataaattgcattagtgcaaatgactaaatgactaaaaattcagattgtgaatatgtctgtttgtaaaaatgaaaaataatgatctaataatgctttgggtgccaaactcaaatttggggtatgtgtagggagagctgaagacaagggtgaagaaaaataaagaaaggtgtccttgctctgagctttgttttagggaggcatttctcaaactttagtgagcatcagactctgccacacctcttaaaacacacactgctggacctccgtccagaggttctgatgcagttagtagggagcaggctgtagaatttgcatctgaattagcaagctcccgggtgatgctgatgctgctggtccagggaccacgctttgtgaatagctgctttagggtagtggctctcacccctggctgcacatcagtatcagctggagagctttagagaaggtcctgatgcccatgccaaacccagcccaattaaatcatgtttggagggtgggctgaggtggacatcaaatgtcaaagcgtttgcaaagctttttccaagctccccagacaattccaatgtaagagatactgcaggtcacctgctatatgaggaaggttagagtgtgctttatggacataaacaaagtgtcctggttttgtgttttggagggggattaagcagttatgtaaaccttaattagttttgatcacagtataagcagcggagttagatctgcctgcatgtaagaaggaaaattttaaagtccacttttcttattacagacccacaaagccgaacaaactccaacgcaaacgtacactctctaccaaaatgccacaagggatatttagacaagtaaagggcgtaggtacaagcctaatttacagccattcacatgtattatttgcaaagagcttgagccgaaaggaaagccttttcctttgcagcgccttatgggggaagccacgctctgtctgttcggaacagatgtcggccctcggaggggtttctctgccaggaggcggcccaggcctcagtccgtgtttctgatgcgggataaggagggggcatttccttgtgggagaagccccatgccccacgccccgtgggctgggggaggctggaggagcagcctagggaggggcggggctccggagggaacgggctgctctcagagcggcggccgccagggggcgcccttgctccccaagcgggtgacgccgggggtcaccccaccctccagcctctgttttgggtcccgctctgtcactcctcctacccccactggagtttgccccctaggggagggggtttgggaagcgagaatcttccccgggatgccggggaaagggcaggcaaattaaatgaaatcattccggtgtggcatttaaatggtcaagtgaaggctggacttggaatgagtgttactagctttgtgcaaactggcgcctgctcgcccttgcgtaccgccttcctccttcacattctctagggctgggttgatgttttttaatcttagcccctaagacttgaccagaaaatttccctttaaagatagctatcataacctgtctctaagctctgagtgactgctgcttgtgcctgtgtcagcagtcacaatagtctctcctttaaggaggtatctggctgtattactcataatttggaaagaatatcacattctggtcccttgctgagaggtctgactgtttcaaactctgttgagaagaaagcaagattaatcccttcccatttgtttcccaccctcctccaaaccagactggaggagtttatgcatatgcattttcaaagagttgaggatataattcaaaggcacatttccaaattagcttctctgggcagggaacaattaaaactggagtaattcatttattctaattgaggttctgcatattttaacataaaacctattgcaccactaatgttctctctgcaaatgttccaaagtaattgggaaggctttatcactccattaaaagtgctgaaaactgtgtgacaaagattaaaactgttctgtcctgaaggctggaatattggttgggaatataaagaagcaaaaatcaagtagattcagaatgatgggtaagttattggtttatgactgtatggggtaatttataaaaatttctacattaaatgtacatgttttgaagcacaaaactctccaatgatcatttttacacaggatgtacgcgttttgaagcacaaaactctccagtgatcacaggtcatagactgtctgatttttatgtgaaatcccattttaagagtaaaatataagtaacatagtaggctctagtctataaacaaagacttctatttatagtttgtttgccccctgagccccatctcatctgctggtggcatgcacatgctctttattaccagtgcgaatatagctgggaaactaatgccactcaccatacaggatggttaacatggacacgggcatgacaaggaaacccagcagcatatcagctatggcaagtgacatcaggaaatagttggtggcattctgcagctttttctctagggacactgccatgatgacgagtatgtttccagcaatagttagaataatcactacggctgtcagtaaagcagaccagtttttttcctggagatgaagtaaggagagacacgacggtgagaggcacccttcacaggaaaggttggttcgattttcagagtcgactgtccagttaaatgcatcagaagtgttagcttctccggagttaaagtcattactgtagagcctggtgtcatcatttaattgcattagggagttcgtagttgagctcaaagaagtattttcttcacaaagaatatccatgtctaagccagaacttgtagcagatgaggtgtagaaggactaacaggttatagtttctgctcaccattcaccttgatgtacccacactctgtaacactgaggctggtgtacatgctgttctcccggggctggatttttgtcttccattattacaatgatagttaaagaactgaactgtggtggctgtaagttttcttcattcacaattttaggagagtccactgtttggttttattattttctcaccaaaccgaggacaaaaaagcagaatgaacttttagcatagaggttgcagggttttttttgagcgctcgggaagataaatgtcctggacaaagaagaaaagttttataactactgggactcttgtttaactatatctcattttgttggttatgccgatggtactagtttagcaacagtattattaaaatagcatgcaatcagaaacagtggggatgtacacattctacattaagaaagtcaattaaaaatacatccagtgttaatcccatagtaattggatgtactttgggttacagttctcagccattcttaagctgaattgccacagctgctgtcaggaatttcagctcctataatgttgcttagctaataaaaggaaaacaaaaaagtcttaagtaaagattagcagacaactttcctccctggaaattctcattgaaatgattacatgttggccaagcatgatttcaaaccggaaagaaaattacacagcaataaaatatagcggcatgagaacttacatttgtcttcagggtccacacatgagatacatttgttattctgtgactcgctgcatctctcacagtaattaaactggtgtagagtcccctcttcttgatcttccaccagcataatatgatagtaatttggtttctgttttgctgacttcaaaaactgcatgcaagagctgagccagctcccgcactgctaggatcctgttggcttcctctggcacggctcggctgggttcctccctccctgtgcggctcgcctcagcaggcacacatttagaaatcattcacgagcccctcaaagtcgcacaaaagaactgcatgggaaagtaggaagagctgtctgcaccaagggactcctggtttccacgggaatggagtagctctctgactgtctcgttcatttcatcag

SEQ ID NO: 1755 - DNA, 65535 bp, Homo sapiens; identical to SEQ ID NO: 1754
  source 1..65535: mol_type = genomic DNA

SEQ ID NO: 1756 - DNA, 24828 bp, Homo sapiens
  source 1..24828: mol_type = genomic DNA
cgagagcctgaattcactgtcagctttgaacactgaacgcgaggactgttaactgtttctggcaaacatgaagtcaggcctctggtatttctttctcttctgcttgcgcattaaagttttaacaggtaagtggtgtattgaatatttcttattaagttataattcaagtaaacattaagaaaaagcaaaggtagaaaaattacgcacccaaaagacagtggttttggtttttgaaagtaggaatagtttcaggatatggccaagggcaccatgtcactcatgtcactgtggatggcattgagtttgcattgctgcctttgatactgtgtcttgagatgaaaaacatgtttcatcagaccattaaatttttaaattacctgcttggagttacctgtcagtggataaactagcagagtggcttactgttcttagagaaagatgaaaggcaaaatgacttgtgtcaacagaatgaaaattaaatagctctggcatttggactgggaattctttctgtggtagaaaataaaatgggaagtctttgaaaagaaggattttgattttaatcttacctggatgatctgttatctgaaatgtccagggcaccatagagtttttattgacactaagtatcagagttcaccctaaaaagccaaggaggaaaggataatgtaaaaatacttcctagcccctgtagaccttacaaaaaagatcattctggagtccctgattccttctcttgaatggcatatagcagactctatatggacaatttaaataatgctacatacaatgtaagttaatacacgtgtttctgctgctttttactgtatataatttgtactacttttgttttctctttcacactgagccctattcttgaggttgaaaaaaggaaagttaagtaatattaaataacttaaataatcaaataaactaaaagtgaaggcagaacttttagtaggtatgatcctatctagggatacattttttcagtggcaaaaaaatagaccttactgttcttacaaaaaatgaaaaaaaaatgaaatcaaattgatcaaatgtttcatcttgtgctggctcaaagtgagttaagtgcagttaagaggattgaggaatgtagaatgagcacaaggacagttttgggctacttgctggtttatgccttttctagaatctcatgaagtcctttagcggcatgaatgacatgagcagctttggaatttatattcattcttcattcatccatttactcatgtagcattgagcacctgcctggtagcaggtactgtgccagatggtgtatgtacaaggatgagcaaaaccaggtcaacccctgttctttggaaggtaactgcatggtagagagagatatattaatcaaataatcccattgattaatgataattacaggcaaaactcaattatatgagggaatgtaacaaggagcttgactagactgggtgggtgtggaggtgtagctgaggagcagggttcattgaagtctttcctgtgcaagtggcacttgagcggagatttcaaggacaaggtagcaatcaatggggagaacggtatgaaggtagggaagaacgttccataccatggaaggaacaagtgcaaagagcctgtggcaggaaggaatgaggtaaggttagggaactagaagaaagcagacagatgtgcctgagcacaaagagggaagaggctgagcttggtccaagatgaccaactggtccaagttggtccaaggtgaggctggaaaggaaagtagaggccagaccattcagaccatatagtctatgttccagattttggatattcttccaagaacgttggtaccattcgtggaagggtttgtttgtattgataaaaatcattcaactaggccaaaccaatttgggcagttctggttgtggtattatgctcaggagaattaaagtagcatcggtgtcaattctgtggaaggtgagatccagccttaggtaggattgttttaagtttccagattaagctgacgaataatttgtattctggaacaatattcatcgtagattctaaatgaatacaaccaatgttcactctcattataaagaaagccatgagatgtggcatgctgtttggcatgtggcaaacctgaggcacgagtggctaaatggtaacaataaatctgctagcaatgatcctatttaaaatatctccacaatgcatgtatccagaaactgccatgtaaaagctctaaagaaaaagagccaaactcaagtaaactaagtacttgcttgtcctctgttgtattttcaatcctcccaatttacataggctttctcatgccatgaagatgtaggcattcttacctttagtcagtgtttgaagaatttccaaccaggaaaggttaagtgatttgttacacagtagttggtggcagaaccaaagttagaactctaatgtgactccaacatctacattctttctaaactgtgttgaagtagtggaggtgtaacataaatctaaaggaacgtaaatctcaatgattctgatcacctttgttatttggttgtgaattaagaaggatgggaatcttgctgatttctagtctttgatggatctcaatgtagaatttaacaaagtcttgtttttttttaatgaacttggagcaataggacacttttaattataaaaatatctacgaaaaatgtgaatgtctaactacattttgaagaccctctttgtagaccttataggcaacagggaccatatgagtgatgggacaaattctggttttagaaagactactttaaaagcagtgtggataatacaccagattgggaagggctgatggcagagggtgtctaataaacgtgcatgtattatgatgtgttctgtgaggaagctgggaggatagccctcaaggccactttgagccttcctttgtcactgaggcattccattagtgactcctgaattccacttgggaaaagagcccctcagtgtctccagcgtctgagagaagtctgtgaagatgactgaccttggagcccctcttagcctctccacgactgagtaaatgtcatctcctgacagcacccccttccagagtgttcttgttagatttaacaaaaatcccagttgtcaattttttcttttgatagatgaattcaggccattcccagtcagcataagcctctacttgattttatttctatgtttatttactacttatttttctttgttgtatcctctttttctcttttatttttgttggtgtgatgaaatttcttttgactctcctctttgcctccggttaatttggaaggtcgactacagttcttaatttactaagtaattgacatgttcaaagaatcttaattgaatgtctacttgtttatcattgtatgaaaataatgaaaatgcctttgtctgatgtgcctagtccccatcccctgcactgatatgagaacttaagaatgttcttcctttcccactctcacacttcccccagacagtgcaccctgctccatacgtgggttttgtggaaataatttaaaacttacagttgcagatcattgctaggtttcctcttacagtatttctcttctgtttcaagaatcctttcttaacacttacatcacatacgttcaatgacaacatcattctggacatctgctcctgtcttgtgatctctgttctaatctaatgatcagaagacttctcttattttcgttaaatacccccaactctctgaattccagtacaggtaagggtgtcttccttttaccttgatgagtgactgatatctttcctgggaataggagtcctggatggcagcctttcttcttagtggttgcagatattcctccactgtctgctggcttctagggttgtgggtgaagagtttgatggtagtctaactctcattcctttgtaaaaaaaaaaaaaactctagaatttcataatcttgaaagctatttacttcagtattggaattcaggaattcctccaggatatgtgtaactctctccctctgtttctctttctgtgtgtttctattaattttttttttgaggcggagtctcactctgtcgcccaggctggagtgcagtggcgcaatctcggcttactgcaacctccacctcccgggttgaagcgattctcctgcctcagcctcccaagtaggtgagactacaggcacccgccaccacgcctggctaatttttttgtatttttcgtagagacggggtttcaccgtgttagccaggatggtctcaatttcctgacctcgtgatccgcccacctccgcctccgcctccgcctcccaaagtgctgggattacaggcgtgagccaccgcgccccgctgttctattaatttattattattttttttaagactgggtgaaagttttcaatctctagactcaagctttattcttcatttcagtcatttttttcctagtatttgtttaatcataccttatgctgtttttccccactctttctagaaatgtctcttattcttatgtaagatcttgagtcccttattttttcatcatttgtgaacaaaatggctttcacaacttgctgttgcttgttaaccacaactccttcagatgaaatggatatttcagttttaagttactagtagcatattcccatttcttggtagaaacaaaatgcaggcatgtaggggggactgaaattcttatatttactcactgtaagattcatagcattatttggcttaaaaaaattcatcccagtattcacagttgtaaacagcaaaatctacaacatatactgcttccctactctaagaatattgagttttatatgcaaaatgacttactgggctttgcaaatttttaaaaatgagttttaaaatcatttgtagcttgcaataactgaagaaaagatcacaatttctctgtaaatggcatctcagtactactgctgttctaataaactaggtctgtcaaatggcactttttggtcattcaaagtgaaaaaaacatggcatttgaaaccttataaaaattcacaattatattttggaaagtggaacttaagtatgtaggggatatgtcacacaaattgaaagtgttagtcaagaaatgattttttttttcaatagtttggcctgtaaggttgaccaaaacaggtaaagatttgcaagtttagagagtcagaaactggggatatgaacttccttctggttcatgtataacataatgatgcttgtatctactttgcttgaggaaaaaaaagaaacacgttgtccccaaatagggtgatagaccaggagtttccatccagttgaccacgagtgttgttaggatctgtttatttgagtcatgttgacacagacacagcactttcaataagcaattaatgatcatttaaaggtaacttttttgaatttgataaatagattttttttacagcctgtatttgtgttcttctaggactttgcaacaaagaatctgtacatgcaaaaacaacaataacaacaacaagctgtctactgcactcacagttaaagttctgtttactttgcactatctaggactaatgcaaaaatctcatagatgtgcctatttgcacttatttaattatgatgaaatttacttctatatgtgaatccatttctgtacatttctacaggcagataagtgatgggaaaatcattaagaatttagacttcatcagagaagaacccaggtacaatgacagcccagcttaatacatgatggctgatgaatgaaaatgtctagggaaatgagtgtgttatgtacaatgtaatttcatatctaagtcactttaaaataattttttgatatataataaccctttcaatcacagaacacatatgtggcaccaatgtgaatactactttaagtattaaggtgataatatatccaatatacctagaaggaaaataaatacctgaaattcattttcatatctagcttaatgttaaaagcttctttttgtttttttatttcgtagcaaatctctttagctctgatgctttagtttctgtacaatgagaggattggactagattattaggtgaagagattaagtaagtgtgtgtaccctggtgtcaaattatcttattcttttttctttgtttttgttggactgggttaattcgaagaccttgtcttcaagctctgaatttctttcttctagttgttcaattctattgctgagactttccagagcatttcacctttctaaaattgtgtccaaagtttcctgaaatttttattgttttttctttaagctatctatttccttgaatatttctgccttcacttcttgtatcattttttgcatttccttgcattgggcttcacctttctctggtccctccccgattagcttaataactaacctcctgaattctttttcaggtagatgaagaatttcttcttggtttggatccattgctggtgaactagtgtgattttttgggggtgttgaagagccttgttttgtcatattaccagagttggttttctggttccttctcatttgggtaggtgctgtcagaggggaggtctagggctgaaggctgttcttcagattttttttttgtcccatggagtgttcccttgatatcatactttccccttttcctatgtatgtggcttccagtgagccaaactgcagtgattgttgtctctcttctgggtctagccacccagcaaatctacccggctctgggctggtattgggggttgtctgcacagattcctgtgatgtgaaccatctatgggtctctcagccatggataccagtgctgttctggtggaggtggcgaagggtgcaatggactccatgagggcctttagctttggtggtttaatgctctatttttgtgctggttggcctcctgccaggaggtggcgctttccagaaagcatcagctgtaatagtatagagagggtctggtggtgggtggggccctagaactcccaggattatatgccctttgtgttctgctaaccagggtgggtagggaagggcagggctaggcatgtctgagctcagactctccttgggcaggtcttgctgtggctgctgtgggggatgtgggtgagattcccaggtcactggagttgtgtacctaggaggattatggctgcctctgctgagtcatgcaggttgtcagggaagtgggggaaaaccggcagtcacaggtctcatccagatcccatgcaaacggaagggctggtctcactctaatcatgcctcctctaaccgccccaagtctgtttccaggcaaagggcaagactggcttgaaaacttgcctgaggctttctgcctcccagctgtgaaagaaaagggctttagtttttcccctgcatgtgaaatctgcatgctggattcacggcctccccccagttcaggccaggagacttcttgccctgttcaaatagttacaaagttcagctagagaattccttctccctgtggagttttataccctgctcctctggccaccctccagatggatccctgtggtgcctggcaagaatgggctgcttggggacccattgagctcccagagcctttctgcagcttcctctacccctgtattttgctccgtttggctctctaacttgactcacctccagataaagtcggaaacttctccacaaacagacgctcagcttctccggtcagagtgtgtgtttgggagaggagggtctccctttcccgtgagtcttttctttttgactgggaaataagtatctcccaatcttcagtaaataggatctttgctctccttttcccactcctcttcttggcccattacaaagatatttaccaaacatgcttagcctttatattcttctgttaatattaattcttttatttaatatgattgagcttccactatgttcaaggtcctgggattttttaggcaactgtaatgcagtccttatctttgtggagctcatggttaaatgaggaagacagacaaaaataattatgatccaagatgctatgtgctaaaatatactggcctaaacaaagtattattgggagcatagaaataagagtctttgtctggtggtcttggaaataaatatctcaagagagaagttgacatttaaaatggttcttgaagagtgaatgagaatttcttctcagattaaggggtaatcaaatattttagttcatggtaacagaaataatgaaatgtgaagcatattctagtagtaaagaacagaagtgtgaaagaaatggccaaaaagttcagtgtggcttcaatagatggcctatgagattgtgaaagcattttgtgtcaagccagatatatatattttaaaacaccttataagcaatagaacactaatagagacttttaaactggggagtgaaatgcttttctgaaacataattttgggagcagcatggaggagggatggggaggagagagatcagtattgagaaggccagtcaagaggatgcttccacagataagggaagacatgaaaaaggtgtggattggcaatgggaatggagaaaaagaattgaatttaagagatattcatgagctggagtcaactggacttggtgaccaattggatgatgaaaatcagagagaggaagaaatgaggaagactctgaggttcctagggtcagactagtgactccctgaaaagacagggtttggatttggtgaatgaatacagtcacgtgccacttgacgatgggaatacattctgagaaatgtgtccttagtgattttgttgtgtgaacatcatcgagcgtactgacgcaatgatgtctactagatggcagagcctactgcactacctaggctatgtggagtagcctattgcttctaggctacaaacctgtacagcatgttactgtactgaatactgcaggccatggtagcacaatggtaaatatttgtgtaactaaacacataaaagggacattaaaaatttctgtattataatcttatgggaccgccaccatatatacagtccatcgttgaccaacatgtcatttatgcagcgcatgactgtactgagctcagtttggaaaggctatacatgatgtgttagggtaaaaccagatagtgatgttgaaaggaatttggaaacaaggaactagaagtttgggctggagagaaaatgtgggctcctgggggtagacatgagagctggagccataggtgcaaatgagttcaggcagtgaacaccctgtccatgtgcccaaggagttttgcacagtagctgagcaatggcaagcaatgtgggtattcagaggtgtggataaaatcctctctccctcccactctgtggaagagagttgggttcatttaatctcatatgatttccctagtacaatagtttcaaatcaaaggcaatgaagtaactaacaaaataacttgtttgtaaattaattgctttgtgaatattgatacaaagttttataataccactgggattttttcatttttcatgaagaaatcagttttaactaggagaaaatcaatctttcatttttcttattatacacacttagagaaccaaagggttgttttgtaccccctatggagttccttggagagtaaaacaatgcacacattgtgtgtgtgttcatgagcactcttttggctttttctcctcacttttcttcttcccatttttttttttttgctttcttttttttttctccaaatgttaggcatttaggttagattgggtttatcttgtctatcctccctcccttccttgcctcaattacttctttagattatgggtgcctttgaatagcaatgtaagtttagaaatgatgcatatataaaaatctactaaccagggatctaaaggttttagctggtagactcataagacatgacattgcttttatgaaaggtgagaaaagtggtaggaagtacttttttttttaatgccagaatttcttagtaaaacatcaaatataactaaaacctaatataaacattgcaatttttagacttttgcctcttgtgtcacattcatgtgctgtgctaagctaacacttatcattgtttgattacagaaaatgtgtttaataagcactatcaatgattacaaactcaggacatcttatctttccatcactctgagacctttgtggaggtttgtggttagaagtctgagttaaagaaaataaaattacatttctgatatcttgcacgctctgcactgagtgggttctttaaatgtttcctccagaggattttcaaccaggaacaatacaactgcttgcaaagagtcccagcaggatgggtctgggcatgagcatcttatactggtgaaatgaagtagtccagatattaaaagcatcaacttgcaaatgaactcatctgcactatagtgcaattctcaggtgaatgaccttttcttcagaaattttcttaatagtcccccaaaagaagaagaaaatgttcttgtgctttataaattttgaaaacctaaagagatcacttaatataaagatttttattttactcttgaaaacattagtctattgatatcaacagtaatattataaaaattattattattattattttttgagacggagtcttgctctgttgccaggctggagtgcagtggtgcaatctcggctcactgcaacctctgactccctggttcaagcgattctcctgcctcagcctcctgagtagctgggattacaggcacacaccaccacgcccagctaatttttatattattagtagagacggagtttcaccatgttggccaggatggtctcaatctcttgacctcgtgatcctcctgcctcggcctcccaaagtgctgggattacagggcgagtcactgcgcccggcctataaaaattattgttagcagcagttaacagtcttgagcctctactgggaagaatatgccctgttagacacagtattctatgtgatgaagaaaatatagtacctgttctccagactgattataatctagggtttccaataaaaagtaaacagatatggtagcaaaacaaaacctcatgtttaatattcagattttaagactcatcaccaggatccaagaccacatattcctttttgtgattttagtaacatattaagtgctaaaagatataagatgatgtttatatcacaaaccactaacatgctgtgtttataaaacatcttggtatattagaacaaccattggtccaggggttcttgtcctggtcatatattgggcaaatgtaatggctgcgctttgggacatccaagtgagcaaccaggtttgttgctcacttggatggaacaaagttgtcctgccctccacagacatataagagccaagagaattatcaactgtctaaataagtatttatgaacccagtggatatttgaaggtaaagaaagtttttctttaaagctcagacagataatttccattagaacatgacatctcagttggggtagtgtcttgtatgcatgattgtgtatcttcatacacttgtttccagaagaaaagcaataatatggcatagctaactctgggatcatgccccagctatgagctatgtaatcctgggcaagatagtcaccttttctggctctagtttaatttgataaatgcaaatggaaaatgcaaaatgaaaggtttaacttgtcatttctagaagcccttttggctcttatattataaatcctgtgcttcatctcctcagatttaaaatgtcaccgtctatatattcatttgttcgcccatccaaccatgctttcatccatccaataaatactgattgcagcttacaacacaccaggtattattgtagatacttgggatggatttgtgaataagaccaacaaggtccctggttttaaagcttagagtggagtagccagacaataaagaagaaaacaatcagataaaccagataatttcagacagtgataaatgctttatgtcagttaatgtactagataatgacctggatatattctttagattgggtggccagtggtcactgaagaagtgtcattactcttgaacgatgacaaagaagcagccatgtgaaaatcagagagaatgttctaggtggagaaatgagaaattaaaagccctgggaacctgctttgtgtgtttgaggaacagaaagaagggcagtgtgactgtggtgtagtgtgtgactggtataaaatggggagaggtaggagaggtcatgcaagtcatgggaaaccagggtaagaacttagattttactgtaagtggaatgagaagcacctggaggttttataagcagaacaatgactctattggattatgcatgtaagaaggtcattctggtttctctgtggagaatggattgtaaatgggcaggagtaaaagcagaagctcttgtagtcccagagagagatgacaatggtttggaccagttgaagctgagatggaggagaagtggatagattctgttggacataaaacagaggtgctggaaattaggcgttcttcctgctcacagatttttagcactggtcctgtaacactcagttgttagtgaccactgtctagcttcctgtggttgcctgcttctattatacttctgttgattgttgctagtgacactttgactgtggattgaaccaaaaatctttcatgcacccaggaagctgtgtgacctcgggcaaataatttaatctgtctgggccttcagttgtctgtatgtacacaaaagaggtcaccagatctgactgtgtatgatgctgagaagaggttgaatcatgttacaggaaacaaaaagtgtaaagctgagggtatttataggatgcctgaaacatgaagtgttgatgaaatttattagcaatggaaatggtatgttaggaagcatgaggagcatatcaaagatagtatgagagaggatgttttggagaagattttatattaaaggtggtatgggaagaaaaggcaaacatgagaaaaaggaagaaagaacaagaagagagagattggtaaggggaacactgacaatttttaactactggtatggcaacagaattgaccaaatagatttgacaccttaccaatcagagcagacactatctataaaagtggtgctatctatcataccagcattccaggctgagtattagacttggagataagaacatccaagaaggatggagaaaagatcctagatgcttttgcagttataagaaactaacgtattcagatcttccttaaattgtctatccattaaatgctttagtcatggttataaggggcagtctcctttaatactattttcaaatgttaccaaaggctaagaagaatttgtaatttgtcatttgagcattgtcttagtccattttctgttgctatcactgaataccggagactgggtaatttataaagaaaagaaatgtatttcttacagttctggaggctggggcctaagtctaggggtctaggggcctaggtctaggctgaggcctaggggcgaaatctggtgagggccttctttctggtggggacactcatcagaggcccaaggcagtacagaggattacatgatgaggaggttcttgagagacagccaatctggctgtttataacatactaactctcatgataattaacccactcctgtgataacctattaatctgttaacccattaacccatgaattggattaagctattcatgggggttctgccaatcatctcttaaaggccccacctcccaattctattacactggggattaattttcaatatgagtgtcagtcagagggggacaaacattcaagctatagcaagcatatctgttctatatctgccaaaatagttatgaaataattaattaaatgctatagttaaaaacattcgaactgcagacttagagctgtcaagcggttttccagatggaaagtttaaacactggatatgtggaaacctaagtcagccttctgatcactacatttcataataaataggcgatccaggtagtttttaagttaaagataaaaaaatgagtaattaagagcgtccaggccaggtgcggtggctcacgcttataatcccagcactttgggaggccaaggtgggcggatcgtgaggtaaagagatggagaccatcctggccaacacggtgaaaccctgtctctactaaaaatacaaaaattagctgagcatggtggcatgtgactgtagtcccagctacttgggaagctgaggcagcagaatcgcttgaacctaggaggcagaggttgcagtgagctgagattgcaccactgcactctagcctgctggtgacagaacaagactccatctcaaaaaaaaaaaaaagagtgtccaatagaaatgacactctgaaatcttcagctgatgtcagtggcacacactctcaacatgccattcaagaaaaattgaggcacggcattcctggtcctacctaaatacttttgtgggcaagaaagacagtctcctttattttaatttattctgactttctggaatagcccattatgatattgagacagaaagtggttaacaggaacattgttttccctttggaagacttacccaacagcaaagaattagctctctcagttgtttgcagtcttatctggatatattctgatgctgaatccagagaaagcaggtgttagaaataacattaagatgtttttgtttcacttcttcatttcacggatgaggaggctgaattccacaggggtaccctagccacagagccttgctagtggcagagccagaatttgcctctggtttccttgggatccactgcaatgcacttccaccacactgcaccgccaaccattcatgtcctcttgtgtttgccacagtgcgggcacaatgggggaaaaatctgctgagaaaatcatcttcggaagtagaagacaatgcgtctatgtctgtgtatacatggtgaccacagacgctttggctccaagatcattgtggtttacttgctgccattctaaagtctctgggaaattttttgtgaacatttctaaaggaactgagaacccgtccactgattttatcttctgcagcagacggtagagacatacgcatcaaagcaacagtggggcaacatattttactgtcagacaaataaagccccaagcaaaataccctacgttttaatctaatgtagactgcacctgttctcatgccaacagtttttttttctttgcctctggataatattgttccttccagtttttaaaacgaagcaagtattattttccttctgtatgcttttaaacatacttgttattataaaacaaaacatacatatagaaaagtgaaaaaaatgtataatttaatgaataatgctaaagcatactatcttaccctcataatcaccacaggtcaagaaatacaagactgtcagcacccctatttccttctgattccaactctttctccctctttagacaaaaccattaggctgaattttgtgatactaattcagattatattaactatttctattttttagtaattatggaagaaatcaaaacatgtatacttcacttagaaaagtttcaaattacatataccttcactatctttctagacaatgtgctctatattgacagatgtttcttttagcacattggaggtatatgttataattccactgtatcagggcttttattgttgatgttgaaacagtctaatagttgctccttggaaggtaatcagtctcttttctctggctgcttttaggattttcactaagatacatctaggtgtgcatacttttaaaaaatatgcttgtgaattgttgggattcttgaatctgtggagtgtgactgggttctaactaatttttccaacctatctgctggttcaccaattttctctttaactctgtctaatatatattaaacttatctattgagttttaaatctcagtgcatttttttggccgattcttgtaggttctttttcaaattagttgacttaaattttcctgtgtactacagatattattacaagtttttctcttatttgcttaaacataataagcttaattactttattttggggacctgataattcaggtatataaatcatgagtttgtttttgtagtttgttgtttctgttgttcccttgttttcttgtatgtctcattatttttgtgatgtgtttgccattgaatgtgaatattatttgtatgaaattttttgaggcctaggatgtaaaccttttcttcttgtaatagtttgcatttttactttcaaaagctgaagggtaataataatgcaaatctccttaaagaaaattcaaggattgaggttttctaaccattgaagtccagaagatttttctggaccatctaatctgaatgaggtctggtttatttctttacctgtgctccaagaatgtaactctttggggtcccaatttattggggagagggttttctgctagatcactcactctgcagattctgggagttgagacataaaaacaaaagtttgaatttgaaagaacagcaatgctttccgagtaaaagcagcttccaagctttgcctgtctctcggggttctggttctctcttcaaatttagcctggtaatttctcctcctttgtgtcattctttaatgcttttaataatatttttggacatttgttcaacatttttggttgttttggcgtgagaattagtttgaataatagggactgctataactgaagactagaacacttgtgcttattttcacaatcaaatcacccaaattgaagatatatagggaaaatataaattgaagcccagggtcattaagaaaataagtaattgtgtatcttaaataaaattaaggcaactagtgtaagtagaggtgtgacaaatagcccctcctgcataatgctaatcctgttacaaatttcagaaagcaaaatggcaatacatagtattataacttttaaacattttgaccaaatgtcataatatttacataaaagcaaaatgctgaaaataatcccaatatccaacgttagtattttagttttaacaaattatgatagattaacattttggccaataatatagtcattaaaaaggataattatgatgactaaaaatgaaatgtttatgacataaaataacaatagcagaacacaaaataacatgtttgctataaataataagtatgtttttgcaagataaagagcaaaaatatacaaatagtatttctatttcactgtagaactaggtaatttttttccttaaaatttttttacacttacatagttttctcaaaaacaaagaccaagatttcaaaacttaggaaaaaaccagcatactaataattttcccaaacaatttcagcatgaaaatttgtcatattaaaaaggaaaataaaacaaaaagaaagagaaggcaatgagcagtttgaatttatagtctaataactcagaatctgcaaccaccaggccaaggtgatttcagttttttccttctgtgattcccatgtagcttgcaaaaacaaccttggcttcctataagcataaatttatttcagaaaatgaaaaagtggggctgggcatggtggttcacgtctgtaatcctagcactttaagaggctgaggcaggaggattgcttgaggccaggagttcaagaccagcctgggcaacatagcaagacctgtctctacaaaatttctttttcaaagttagccagatatggtggtgtgtgcctgtattcccagcttcttgggaggctgaggcaggagggacccttgagtcaaggaagtggaggctacaacgagctaggatcatgccactgcactgtagcctggggaacagagtaaacccttttctctgaaaagaaaagaaaagaaaagaaagagagagaaaaagtaaacaaaaatctggggctttatctttattatcaggccttgattcagttctcagtggatgaggtttggagaaaatacatttctgtcatttgaaaatgattagtctgttcttttactctttagcaggaggacataatgtatgtgtgtatatatgtatgtatatgtatacaattatttgtatatatacacacacatagtctctatatattgtaatatacatatacatataatacatatattttaatatataatatgtaatatacatacatatataaaatatatatacaattattcatttttaaactacttcgtacttttacaaagtgagcaatttctatctttccttttatctgctttactgatgtacatcagtgattatttactcatcagaagtacacatggttcttgtcagagtagtttgatcaacaggtagacaattccttctccccaagatatacctactaataaatgaagtttttcctaaacttcaacttttcccatatctctctgtttagctaagtgctactaatcctttaattccaattttaaaactcacttcctcaaggcggcattttctgattctataatcaaaattataacccacctgactctaccaccttcatttaaatagtactccattcctatcacaaattatgttgcattactacatatttattcctttaccatctgcctccaatatgaaagctaccaaaggacagaggccataccagtttgattcatacacactatgtaaatatattatttaatatttagtatattctatattcacatatgacaagcaagtttctggttaggatttttttttctctaggacatagttttatcttatgttcttccttgaggggtggagggagaatgtgaagctgtttcattttggtgcaacagagatgactttatgcattgaataaattgcttttatgttaaaatataattattagggcaacattataaaatgtcacttttgctttgttttctttctttttatgcaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatggtaagacattgctttcatcttccaaacttaagagtatatatatgttttgacaacttttctcactaataaaatcaattagacaaataaatatcttttgtgttggagttcacttagatgcagttgatggtaatcatttataatgaagatatacaggtgatgatttactattaatcataattagtattattcagcaatatgcaatgtaatcccatagactgctaagtcagaaatagatcatattgccttttaaacacatatgctattaaaaatcaggaaaaacattaagacaaatacttaaacttatggcttaataatgggtattatctctattcacctaagatttaaggtttggttttgcactgtgtttgtggaatgaagtatgatgattgaaaatcatagttttataacattacttttactattacctcttttataaaaatataggcagaaaagccctttctattaaccacatttgtaaatacattatatgcataatcttttaagttttagttcctggatccttgccataatactgagatgatgttagtctaataacttgcccacttactggatttcatgactataataaagaaaagcttcatttgattaaatagctcttttaaatttggtaagagaacttgtggttcagcagaatttttcattaacatacctttttttccaatccagaatcacaactttgttgccagctgaagttctggttacccataggatgtgcagcctttgttgtagtctgcattttgggatgcatacttatttgttggcttacaaaaaaggtaagcgatttctatctttccttgtatctgctttacagatgcacatcagtgattatttcctcatcaaaagtacacatggctcttgtcagagtaatttgaccaacagggagacaattccttccccccaagacatacctactaattaaactaatcacttggaacagaaatttatgtatttgttttatagcccacacattccaaagaggacttgacttgatggcttacagagagttacattattattattattgttcaaactagatgaggaaattgaggtcaagagaagactaaaggtcaggaggaaggttaaaacatcaaaatagatgactctgatttttaaaaaattattatgcatgggctgcgaatttgaatccaaggttcctgagaggcagggcagagatgaaacaattagttataagttttgcttagctggtaagttaaaaacagtcagcaagaaagccttctaaggtgtcaattgtagctgagaaggaaattgacaacttttttacatggtaggttattagactccttgcttttaaagaaaaccactgaggagctatttagaaagataaacaacaatgacaacaacaaaaatctccctgtgctgggggatattctttttggtctcttgcattacaggttctcaatcaaagaactgacaccactctgcatattacgcgagtatgctagtactcaagtatatccacagtgtggtcattggccagtgtatatctgtgggagagtggaatttggaaagagacataaagaaggaagagaatgagatagcgcccatggtctaagtctgctgggaaagaaacaataaaggcaaaaacgaggaagaaagttcagtagaaagctctttttatgtaaagcccttttcatattgtttttctacttagcctaaagccaggaacctaagtcacattatcatgtttttgtcacataccacttcaacaaagaatagaaaacagtcaaaaaacaaagagatggagaagaaaagatgaccaagcatgtttctggctttttctttcagaagtattcatccagtgtgcacgaccctaacggtgaatacatgttcatgagagcagtgaacacagccaaaaaatctagactcacaggtatgactccatttgggggtttgggaagggaagaggtttcttcacagtaagcctggaatgttaatttttttttttttaattttaaaggaaaggaaaacatctccaaggcctaattctagaattttctgtgaaaatctggatttctcacttttaactagatttatattttctgcagtatattgaaaacaaacaagcaataggtttgtaagccactattgaaactaaacacacaaacagctcataaaccaccatagtatcaaggcaattttcccattgatgtttcaaaagttgggatgattctaagtgttttttgttgaagggttcattcagtcattcaatgagcgtttattgagcatcagttaagtgtgagttactgagtgaggcactctggggaatttggacagatatatgctaattttggactgagattaggaagagagatctgtgctggtactgctagagggaagaaggagaaattgatgaagatatctggttattttgaggtaaagagtgtgcaagtttagagaacttggatggctttagaagtctcagtaacatggaaatttgaccttttctgttaagagtcagaaaactgaaagttgccaagtttgaggagcacccagaaagtttgaagcttccattgtggaaaattcatgtcttatgcccttgaggttcgaatgatgtgcgatgtgtaatgagacagaagccactgcatttttccacccctcagtggctacagattatctaaaggggacacacatagcttgcgttgtcatggaattatagcatgggatgggagctaaaaaggatccttgagttcacatttcatgttttagatgacagaaattgatgctcaaagtgttcagtgactcttttggttccctagacagttaatacctagctttgacacttgcaaagagcttatgtttcattactttgctgtttaaaaaatatatgatctctcaatctctttgcttaatgtgttctggctgtttggatccccacaagcagaacctgacataaggacttgggtgcaagtagtttatttgggaggtgatcccaggaagaaggggtgagggggcagggagagtgagacagccaacaaggagaagcaaatgaagggcgcattattatcaaggtctcagctccaggccacagaggcctgacttcattggacctctgagaagtgtacagatgcctcccagaatcattctcttgaaggatggcaaccactggctccatcctcactgatttggggttgcctgcggagggcattagctttccctcatctctgagctgtgcctctacttgggatgagcctacttgggatgagtcttcagagaaagtctggaggcagaaaagcagtgaaatgcagtggggctgttgtgctagaacagtcagcccatgcagcgctttctgccccagcagcagctgcaatcagaggtggacagtttcaaagtgatgagtttagataatgtctgttataggagtcgagagctaaacttctctggaaatggggaactggtgctgggtgttgaagcataaagatgagtttgcatggtgtgtgtgtgagtgtgtgtgtgtgtgtgtgtgtgcacgtgtgtgtttgtgtgtatgaaaggcaatggagaggggaaagcttcttgtagggaactggcacatggagagcatttagataatttatgctgaatttttgttacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaa

SEQ ID NO: 1757 - DNA, 9098 bp, Homo sapiens
  source 1..9098: mol_type = genomic DNA
ttaactttgcaagaaataaatttttatttttcttcattatcatacagcatttaagaataataaatctgtcttgaggtttcaaatctgagatatctatggcaagtttataaaaagtacattgatcaaggtacaatttttaacattaatatacacattccataatctcatctatttaacattaacacaggcctttgttgttgttatttttttctccctacaatatttcctgactctgtaggacagtggtcctcagttgggggttgactctgtcccctaggggcatctggcaacatccggcataactgtgggtgtcacatgagagggacgctgctcaccatcctgcaatgcacagcacagaccccaccacaggggttttatccagcccaaatgtcaacagtgtcaagtttaagcaactcttaccgagtgggactcaattcccattttatgaacacctctgtgctcactgtaattctgaaaacacagactttgctaactggtaaatactatttacaagaagattcaacctaatcaatatcacttatcaaaagcagtggctgactgtaagtatcaacatgtttccagaatgaataaaccacacaatcaactcagaatgatacaaattagggtccatatcatttaatttcccttgaacctgctctgctagtttaatctgctaatatgaaagttaattaagactgttttgaaggagcgagacaatagtttcctttgcacatttttctgaactatgagaaaaatttaatgatacataaagcacctggcaaatagcaagtcctctgcaagtgctccggaaatgtttatcacagcctactaaaaacagagtttcactcatttgttcaaatttcccataagtatgtatctgcaaagattaaattaagttttatttgctcgctctcattttacaataatctctcacaaatgtcgcttagaaacagaacacatatccagggtgtgtgatacaaaattataagttagttttttccacacaagttttaaagtatcagtgtatataatacattaatgatagtaccaaatgatagaactaaatttaatgataaattaatgatagaactaaatttaaaaggaaaaagtcattctaagtttgttaagcagataaatttttctgtaatcatttacctacatattcacattctgtatattttctcatggtcaacaaactgattcaaatgatttaagttatcccaccatttaaagagaaaagtcgctgcaataattttaaaccatggcgttatcttaatttcaccactggctgcttttttcagaagttcttttagttcttcctttgacacataacaatagcttttaatctcattgggatctggattcaaagttacattcttcctcaccaacaaaatgtaatcaatttcatgttcaccccagataccatcagactgagctttgtagtgaattcgtgttaaataattaatttcttctggaggaacctaagacattaaaaaaaaaaaagtaattaaaacatcggccaccgtaacaaaaaaaatctaaaattagctcactgtattacagcgatatctcgaacagcagtatagttttaggattagaacttggttaaagcattaatctcctatcaatggtatatggaaatcttaatattatatatggaaaaatgattacatcattagtttcaagtgtttgcgtttttttcccgatcagataagtttttttttttttaatgttaaaaaaaggggcagtcactcaaactagaaatgtgacattcttctttttcttcttttttttttttttgtgagacggagtcttgctgtcacccaagctggagtgcaatggtgtgatctcagctcactgcaacctccgcctcccaggttcaagcgattctcctgcctcagcctcctgagtagctgggattacagacgtgccgccccaccatgcccagctagtttttgtatttttagtagagacggagtttcaccatgttggtcaggctggtctcgaactcctgacctcgtgatccacctgcctcagcctcccaaagtgctgggattacaggcgtgagccaccacgaccggcccgacatttttctttttcatattttaaaattgctttttggaaaatatagataagaaatactttatttatccaggtcttatttaagggggacaattccaagaaaaaaaatgatttcaattaaaccaatgagatttatggttcatattcctaagagtttccatcagaaaatcttcaccttttttgtaggtggggagttttaggtgagaactggaaaacctgtcagttaaattctacaagagctgtaacacttgaaaatactcatcttagatttgatcaattatagaaatattcaaccttatatagtgcttaacagatcaatccatccccgtattgagctaagttttgacaagtgatattaagaaattaaaatttaaataatctttattcaagatggtttgtggggctaactcataactccggaggttaccaagcagagaactacatttgaatttaaaaattttattaaaaacctttttatagtatgtttaggtttcagcttgtatggttgtgtaggagagctggttacctcttccaagggaattcctagctcagctttcagccgtctctgtgctgctcgcctcactccaagggcgtcactttcctcaagctcggctggattgcttaatggatgactacaacacgtattcgtaaaacaacctggaaaatggtaatacagagacagatcaacttttcttcaaagtaggtctgaaagatcaagaaaaagttttataagtaactgaaaaatgaaatgatttttaaggattttaaaatcagttataatgggctatcagtaattattttaaggattttaaaattggttataatgggctatcagtaattattttaaggattttaaaattggttataatgggctatcagtaattatgttgtgaaacagactacatttgtaggtaggttccttattaatacttctttaaccaaaaaagatcaaagtgtagataatacagattaaagataaatatgtaaattatacatattgcccaattgcttactagttcttattttttcttgctgttgtattaggttgcactcattgtgtaaactcactttatgcagaatataaaattatgccattcacaggatttccctttgtgaccttggctccaagaattcagaatgataaaaagtcaaattaatgtacaaacacaatattgtacattaaaagtgtactaacctggaaaggtaatcttagcatctgatctttgctgtagcagaagcttattttcggtgttgaataagaagacactaaaagctcgatgcaataatcctgaaagcaaaagaaataacaattattttagccttaagtaccagttatttgccaaattctctccctgcagttcagaataacattagtaacttgctgctgcttttgctttttcccatggtttatccacatgcatagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacatgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaagagaaagaaaggccatcatatatttttctgaatgtcatataaacacaggttaataatgatgctgcttccccatctgcagttgtaccactctgcatccccacagggaccccaagaacgctgccagccggctgctcagcactatctgggtcatcatttctcctacaggtttcacagctggccttttatcacagtcatgctcctgaaggccaagctcaacgttccgctctaaattcttgacctctgagatcctctgcagcacttgatactcaatcctttttccagtgtacttttcttctctggtttttggccccaacctaacttttcatcctgcttttctacaccagcttctgtaatctctagaatgtgctcccattgccatcctgaattgtttttcccactgcctgtctctgcatagttgctcaagattgccacaggccaatcttggttgaaatccattttttcaaggcacaactcgtgccagacattcaataacctttctaccaatgtcacagtaagacttaatccagtttttctcaacccaagctcctgggttatcagaaaaattatttgtatgagttttgtcaatttcccccaggacagtacttagctgatatcattctagataaacaggagaagacttaattcgttatattcaatagatgctttaaggcagtgcttggcaagttttttctgtgaagggccagagagtatgaactctgcctctgtaacactaaaatagtcacaggcaataggtgaactgggcagtatgtaaactgagtgtgggtgcatgccaatatttatggacactgaattacatttaattttcatgtgtcacaaaatattttgattcttctccatccgtttaaatatgagaaaaacactcagctcacaggacgtaacaacaggcagcaggccagatttggcctataggccatagttggcccattcctaccttagtgcatcaaacattaattttctgaacccccatttatccctcccatgtgattacaacgtaaagcacttattagggtactttcagtattctgactcacacttttacatatctgtatccagcagcgtctaagctttctaatctttgtatccttcagggcacctttacatagtctgaccttgaagttttttattcccttttttcttctcctttatttctgaatgaataataatttttgttttctgatttttctacccaatatattttgaagatcccatgtgctctactttctatgtgactctatttcaaatacatagattttactgaaatacttttttgtttctgagagggagtctcgttttgttgcccaggctggaatgcaatggtgcaatctcagctcactacaacccccacctcctgggttcaagtgattctcctgctttgacctcccaagtagctgggactacaggcgtgcaccaccacgccaggctaatttttgtatttttagtagagacgaagtcttgccatgctggccatgctgatctcgaactcctaacctcaggagatctgcctgctttggcctcccaaagtgttgagattacaggagtgagccaccacacggggaccactgaaatactttcaacagagttcaagcatactgcagaatgtacacaaagtgtttaaacagctacttaatacaaagttctagacccacatagggtctgggtgtgtgtgtgtgtgtgtgtgtgtgtgtgaatgcgtgtgtcaggagtcagtgatgatggagatattgatatctaatacaaaaaatctgaaataaggttaatgattaaaacaaatcaagagggaaaataatgtgaaaaggaagtcaacttcagagttagcctcaattttagaaagatttccaacttctataggctagttttatatacagtcatcctttggtatatatgggagttagttccaggacctcccacagctaccaaaatttgaggatgctgaagtttcagatataaaatggcataatatttgcagatcacctgtgtatatccactgtgtacatacatgtgtcacatgatggtgtttcggtacactacagactgcatatactacagtggttccataaaattataacagaactgacatattcctattgctaatgatgttgtagccattgtaacatcggagcacaacacatcaccttttctatgtttagatacacaaatacttgctgttgtgttacaactgcccacattattcagcacagtcacacactgtccaaatttaggcctgaagcaacaggaaaaacagcctaagagcaactggctacaccacacagcccagctgctccactgtctgtctacaccacacagcccagctgctccactgtctacaccacaccgcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctactgtctacaccacacagcccagctgctccactgtctacaccacacagcccagctgctccactgtctggtcctttgtctacaccacacagcccagctgctccactgtctacaccacacagcccagctgctccaccgtctgtctacaccacacagcccagctgctccactgtctaggtctgcgtcagcgcactctgcttccacaatgatgaaagtacctaacaatgaacttctccaaagtatccctgttaagtgatgcgggccgaacgttaaattatcatctgtagatgatctcttatagtatctaaaacatgtaaatcctacataaatagttgtgctgtattgtttacagaataagtctgtatatgttcagtacagatgaaatttttttccaaatattttataatgtgcagttggttaaatccatggatatggaccccaaggatacagtaggccaactgtatattaggtgatcactaagataggtttcgttactacataattactagactttttgacatgactttttttccggggggatggggctgggtcttgctatgtctgtcgcccaagctggagtgcagtggcgcgatctcggctcactgcagccttcgactccgcctcccaaagtgctgggattaaaggcgtgcaccaccgcccagctgtaatgacaattgctctttcaggattttcagaattcagattttaaagctaagctgcataatcacaagataaaatgaatacgtctatttatgcgtttaaagaataccatgtagtagacgcgggaacacatcatccaacccaagaaaaaggtctagttccatctatgcgatgctccccatctcttctcctgctccattcccaggagaagcgccttgagtgtgttgctgtcaccctcttgcacggacgcaggtgtatgcacccgcgtcacacgcgtggactcggcacggggaggccggtgtcgtcacgctcgtgtttctgacgatgctgtctacgcttgtttctgaattctctaaggggagactcgcaactcttagtctcctgcgactcggtttccagttccacgagttcctaaacctcaggtgactgtgcgcagacgacgatcttttccgctgacaaagaatggcaacgtctctgacgccccgactcacgcctccgccttccacggggcgcgggcgcccaccacagcccgggaaggcccggcctccctccagttcgggagaccaacgccgccacccccagctgtccaggcctccgcgccgagacctcacgggtggctcagacctcgggcctcctccccgccccgtcccgcagctccccgatgccgccctgcccctgtctcccgaactccgccgcccgtccacagtacctgatcagcctccggccacagacaaccgccggtcccggatggcgcccgctttgagcacagtctgcggcgcgcaccgcccactggccccgcccccgggccgcgcagccaatcgctcgcgccagcgccagtccacgccacatcgcccggccaattggcgcccgtacgcgcttgacgacacaatctcgccaagcttcgcctggtggtgccacctccctggcctgtgacaacggcagacgcgcgaagcaccgggaacctgag

SEQ ID NO: 1758 - DNA, 51630 bp, Homo sapiens
  source 1..51630: mol_type = genomic DNA
tgcagagtaaaacaatcattttattgattcttatgtcagttctgtagcataatgaatacattaatcataatcatattaaatgtttaactgatagtattttaaaagaatcttcaatcaagtgctaatcctcatcactaaataaacagcattctgaatagtcaagattgggaaatgtgataggtaattctacccactttttgtattgtttctttgttgaattatttttgaaaaccactacaaaattccttattttgagacaaggcaaatctaagcctttgtgcaccatcattgttccccaagcctggaaaacaaaagagagagcaagaggaaaattaaatgtacatgcaattaaacattcctgttggctaaagtaaaatctggcccacagcaatttactcacctggccacatttgcagatgatttcaccatttatttgatagtcggcacacttcttttgcagtgctttgttttctcttacaatgtaaagttccctataagtatcaaagggaaagaatcatcatggagaactgacaaaataccagtgtgtagttcatgggttattggacctggagctcatccgcatgcctgcggtattctacacggcattccttccttccctcctgcttcccaggcttgttattgcaactaaggcaatgcttctcttctacacatacctctcaaggggcatgttgcctttcataacttctttcaagtctgttggttatattaacttgactttagttgttcaaaaatttgagaacaaatgatgagcatacaaaaatacgtgccttggatcaaaatggctttggttcttacacttctcttttcctgccccagtgcagtttatttaaaacatagacatttaaaataggaatataattgagaggctaaaggagaggaagttgtaaaataaatgaatctcatttgcactattttgaaagaacatttacaatgcaacctgcttcaccccttgtggaaaaatgtaaaaatgggtctttctggactcacttgaattctggggtcatattgacgtgatgcattttctcaattacatggatatcttccccagaacaggctagcacactgcagtttttgcaaaggaaagttattagtgatgggttattcttgtaatgcttggcaatatttctcttggttttcattttcttttccattatactttgcatctgtaattccaaaatctggacagagaaaggaatagttagtggtttcaggtttgttttcttttttcagtttcatagaagtaagtctcctgaaatttggaggtcttagttgtgaaaatatacccttagcttatggtctaggaaataaaaataatgaggtaatgaccccccaaagaatttggtatataatcatctcctgtaaccatgaaaatgtgcagtcttcaggtattcaaaaagtagcccattccatttcagaaaagttctattgtgagaaagtccttagcaatattcaacaaaaattctctgtctagcctacccatttgttatttatttatttatttatttattgagatggagtcttgctctgctgcccaggctggagtgtgttggtactatctcgggtcactgcaacctccatctcctgggttcaagggattcttctgccttagactcccaagtagctgggattccaggcacctgccaccatgctcagctaattttcatatttttagtagagatggagttttgccatgttgcccaggctgatctcaaattcttgatctcagtgatccacctgcctcagcctctcaaagtgctgggattgcaggtgtgagccactgcgccagcctacccatttgttttaattctgttccataaaataggtctaaacttccttccacatggaatctctttactaaacactgttattacattaccaagtcttctctaatctatgctaagcacccaaatgcctttaatcttttttcatgctttataattttcagacccttcaccatcttaatcagtctactctttacacatttgtagcagaaaccactagtttttcattcagtgtccatttttcctaacagaaccataattttattctgggtggaaatatgctagctaaatgactacatttccaaaccagcagtcaatgacatgtaaaaagctgttgagtggaattttcagaaaatcttcttaaaaattagatagctggcatgtgtacctttcgccctttccattctcctcttacttcctgcctagaatgaggatgtggcagctgaaattctaaaagccatcttcgaccatgagaatgaaagcccaatgctataacagcataaaaaggagagaaaaggcctggattcctcataacttcatggagccaatactgcctagattccttctgtgagagaatatgcccatcaacctctttattctatgctctgtgactagcagcagcacttattttataatggaaataatctagtttatgtaacatatgaaagttgacatagggactgaacagtgtttataccaacacaacttcacggtagaaaaatctggttcttgaataatttaccgccaaactgacctctcatagatgacatatttatattaaattatggaagaattaattgttttctttaagaccgagggagaaattttcagtaaaagtaagtcatcagtgcagttgaacaaagcccatctctttggcttctaactctacattttagatctcccttcaaggcagccatatatagcatagaaaagagaataaaaccttgcaagcaagcctggaggctatataatagattaatcagacaagtaccaagattaatttcctatgtaaattatagcaaaataatacactgaaatatttttccctaaaagttttaataggttacttttataagacatttacagttcaatgagctgataaggtaattataggatcacatacatgtgggaattaagaaatgtgtatgaatgagtcagaaaaaaaataaagccaaggtaagtgtatggatttgtaatcaggacatcagaagctaaaagactaactctaaaatagtaaaggaatttgaagtaactagaggggtaaacaaacaaaaaaaagaactcataataaatatacaggaggcacagctacaatcagcctaagtccaaataaagtgtaataatgtagcaaaaaaattgaatcaatgctagagaaaaacatttatgatgatcaacttgctcctagaagtctgatttaattttaagaagctctgttatgtttaaactgtgtttatgacatggaagaaagatttcatcttatctgtcaattctcatcattcattagtggttgtctgaagattgtgttgagaaagatgctcaaattagaagaaagtaaacatcttcccagtagcaatgttttctacaggctttgaacagattactggtggcatgtagccctccttccccattgccactcctactctaagttcatctacctgaagtagttttaggagggcaggtttcttggccaaaggagacctaaaaatatagtccattctggggcacccaaagggacagagtcttattctaaagaatgtctggaagaatttgacccttaaactccagagattgtcctagtgttgacccccaaaaaactactcttaaaacatcagtctttgtaaacatctacttgattaattctcttaggacattaactgggaggcagtaactttccagtggcataatttggtgacaaaagtttgatttgatactctaaaatatttgctttgccttgtatttaaaggggttttaaaataaagttttgtgcagaaacctggtcaggaaaccttggagttggtaatagcaatgcacaccaatttgaaagcatccctttagtgaaactctatttaaggtagagccaattccaatgttaagaaactaacattcacacccatatgcaagggtgtgaattttcttctaaatggattgtttgctattatagtagttacagtttttaattcagtggtatgggggatttcctgaaatactatagaaatacattctttcttcactgcattcctttgcacaactcaaataactgtgtgttagtaaattgagatgtagctagatgacatattctgtattttcttatcattcagatgcagcttccctgtcactccttctaagagaccttcctcaaccacccagttgaaagtatccatctagtctatgcagccataaaaaaggatgagttcatgtcctttgtagggacatggatgaaactgaaaaccatcattctgagcaaactatcacaaggacagaaaaccaaaccccgcatgttctcactcataggtggaaattgaacaatgagaacacttggacacagggctgggaacattacacaccagggcctgtcgtggggtggggggaggggagagggatagcattaagagaaatacctaatgtaaatgacaagtaaatgggtacagcacaccaacatggcacatgtatacatatgtaacagacctgcacgttgtgcacatgtacgctagaacttaaagtataataagaaaaaaaagaatttcaaaaactactaaaaacaagaaagtatccatctagtcagttgtttcatatcatcctattctaattctcttcacttatcttgatatattatatttcttgtcttttaatgtttgtttactgtttctgtcctccaaacttcaccaggcacacactagaaatataaacttcgtgcagcaggagtcttatgtgttttgtttcctctgttggctgttcctataaggttacctggcacacagtaggcgtttcatctacatttctgaaattaaaaaactgtgcctttacaaacaaattggatcaaaccaaaattaccatgttggattgaatcagtgagttgcagcagtctttctggaacaaggcaggctaaatttatattatccaaatttatggttggttttactggaatgaggaatggctccctgataatttcctgcccaccatggatcttgattctctgcatgtgaatctggattaagcacagttcactaaacagaaacttataattcagcacaatttttgtctggagaatgagtcacagagatatcaatggcaaccacatgccgccatttttaaatgaaaatcaaattcagaggtgaccaacaataccttatgagcatactcctctggtttcatattttgaacacaatgtatagctttatacatcatcttctctcggaaatcattaactgtctcatgttcgataactcctgaaccactgtgagcaaccaggacgtaggtgctctcatcagctctggctcgaccacgggcctgaaaacacaaataaatcaagtaaatgaaagggtacgttgtgatacaaatcctcctggttttttctgggaatgatattcttgctcagaatgaaatgatattgggttgttcagcatgccagtcttcaaatgggtaaagttagtaaagttagttattaatccattacttgtaagtcagctctttgaaacttataatatgctttaatacagaaaaagtgttctagagtgatgatggttaggcctcaatgacataatatcatcctgtccaggctttttgctctcagaacttctctctcaaactatgagaaccacgatcaatgacttggactgaggagtcgtctttcttggtaggaagctgggaggaatgaatggagagaagggtcatctctgaccttgacactagggctggtgagaaggcaggtcagtttctggcatcctacattacattcttagcacattttcccatgggaacatatttaacatggtgataactttctacaagcctctttatgaaagtgatattcaggtatattttgattaatagaaacttctgtggcctggcccaggagcctatcaactataaaagtatcctcaaggaaaaatgtattctaagtttgattactaagcttatcactgacttacaaatagactcctgaaataaaattatttgctaatttgatggcagtctggttatcttagtcttctatgacttgccttttattcaaggatgcaatttaagttatttaaaaatccctttagttaattttataggaagaatagtgtatctattaatcagcataacacctatgcctactcaacaggttacaataatgccattaacataggtgggtaagagataaagtgaaatctgaatgaaaacagaacatttcactcttttatttatttttacatttataagtctgcccccaaccaacattttatcatgaaaacttctaaacacacagaaaattggaaaggataagggaagaaaatgcagaaacagcagggctccctcaggtttgggcatgttacttcatcagacatttgtgggacagtgtactttagattcctggtccagctgggggctcacagacatcctaggaaagaggaggctgcttttgactcttacaaatggggctagtgtcatggtcctggaaagccttagggtacagaaatagctaaagaggagttgttgtttaaacatacaacaggtatctggttattatatgaattgacagcaatatgaaaggcaacagtgcacagcattttaaaaatgctcttttaacaggaaaaaggctttgttttaaaaactaaaaagatgtttttgctgtttaactaaaagaaagcaattaaaataggaacacaacaaataaaaattaacatagtaagtagaggtatttgaatgtacctggaccatggctatttcattggtgacgagaccataacggataacaatgttacattctttaatatccagaccttcttctgccactgtggtagcgataagcagatttatttttccagtgcgaaatttactaatgacttctttttgttcattctgtagaaacattttaataaattaaattttgtgatgctaaacacattaaaatcttctaattagaggaagaaataataaattgcaactggtcagtgtaaatcaaaggattagatcatacatggatttgttgccatctgtttttggcattgaacaaagacataatggtgagacaacatttgatttccaatctgggattaccacacaataacaaaaatatttccatcatccagtctggaggtgggaagaccacattttatgccaaggaaataaattgatgggtgactccagaggaagaaaggaggagctgtcggttgagaagaggatatgacaatcagaagctaaaatgggcttttttcccccactacattaacttcagaatctttgctatttagaggataagatgcagagatgctttgatatattgttttcagtcacagagaaaatgcacactgtatatgcatttggtcactttaagaatcatttgagttagaagctatggaatattcccaaaaggacacaagagaaactgaaaacatcagctgcatctagggaggggagctggaagactagaggtcagtggtatgccttgtgcctcattaattttgaatgaggtaaatatattatcaattcaaagggacaatataaataaaaatgaaagaagaggttatgcaactgtaaataaaactattttcaaatgaaaaaactctgaattttgaaagtcaatataaataaattaaaatatgacctctcatccttacatgggagaaatgagtgagcacaaacctagcttgatatggacaatgtggttttattttcataaccactctcatcaaagctgttggtccagttggcatttggtgcacatccacactgtctattgcccccatacattaaacaaaaataaagctgccagaccaaaagtatgttcttccatccccttccctttcttctcagaggcagtgtgagtccttatttgactcctactcctaactgtcggagaaccctgtagaaaggcctctcttgagtcttctctgaaaatttctccctccggccctcacatctcccgataaaaacttacatgttcttggattttagcagaagatgcctgtgtcttaatttgaaggagtaactttaataacaaaaattccagacagtgtcagatcttcaagtcacatcacatagatgcctaacaccattgctaaggagtttgtccaccccagtttacaaggtgaggatacaaggagtggggaaggaagggaatatgttctgtattttggcacacagccccttggtttgaaatgaataaggagcagaaagtagcttgaacataggcttttcatttgcactctacctctttttacagagaagcttagccctcttacaataaaagtcacaacgctaaagttaatataatagaaatttaaaaacagaactcataagaatcaacacagaggctgtgagactgaacttgagtttttcctgctagctttctggaagctaaggcaaaaagaaaaacatataaagcaaactacatctcatcaaaaagaaggaagcaaacttgttacccaaggaaaacagtactttctctggcattaattttattggcaatgctcacaggagtgcatgtagagggtatataaagagttatagtgaaccatttcaagaatttttttccagcaaacactgaaacagaattaatttgctccattggcttgaatagtgataactataatagaaaggaagtatccatttgtccagaaagactcagggtcaatgtgattttagccctcagaagaatattttactctaacaaggcatcattgcttcatgcatgcttgtaatgtctactagtgcctttttttcttacccaagtgtttttttactatgcccacagtaagcaacatgtaaacaaagtaaaacaaaacaccttaaaatggaacagaaaacctacttaccagaatcccaaatctctaatatatcaaattctttagttttttcaagtttccctagaggtctcattctatgtaaatatattttgcatagttctagttataacgaacacatttttgtgggagtttgaattttccacttgatactacatggcaatcatttctgaactttgttgttaagcttacatgtcacttatttttgcaagggaaacttagaaagttcttccaattattatgtgggaaaaatgactcctaaaacaacacttaacctctcaaaaaccacagatttgattgctattagccttagattttatttcaagaacaggtgttttatcctgtaaatgtattcatgggtggtgagaggattggtagaaaaagactaaaaacaatttgagaagagtaataacagcataagaaaagaagtccaggctgagcgcagtggctcgtgcctataatctcaatactttggaaggcagaggcagaaggatggcttgagcccaggagtttaagacaagccaggacaacatagtgggacaccttttctacaaaaaagataaaaaaattagttgggtgtggtggtgcacacctagagtcccagctgctcaggaggctggggctggaggattgcttgagcctaggaggtcaagggtgcagtgaatcttgatcatgccactgctcttcagcctgagtgacagagcgaggcctcgtctgaaagaaaagaagaagagaagaagagaagagaagaagaaaagagaaagaaaagaaaagaagtcgtccaaaaggatatttatacctgtgtcatgggtttgaactcactgctgtgtccagctccaatcagatggtgggctttgactcctacttcagcaaatttttcattttcagtaatccactgggaaagcgcatatgcactctgtcgtgtttttgtaaagattattcctcgtgctgattcctcagtcctagtatattgctccattatggtatttcttaatttggtcagcttttcattttcatattctgggttttcagccagccttttcaacattttattgttttctttaagaaataattagagttgatatgttaacaagcttgatttagccactccacaatgtacagatatatcaaacattttgtacaccaaaaatatacagttttattgattaaaaattaattaatttaaaaactatttggaagtataaattagtaaaacatacaacgaattacactagaaggtttcatgaattgtggctcatctacaatcttgcgctatatctaataattaggatggtttaataaataaattcattacaattgtcttgacaataaaactgaatgaccaaatgactgactgtgatcatacaactggtagctaatctggtcatatcattagaaatagttccaatctgagtgggatttcttctttcaaaagatatttctctttttggagagcttatgagaagcagtaagttcatgttgaaaaggtaaatgaatgacaccagtatatgttactttgaatcttaccaaaaaataaagtcatgagaaatctatctgtttcatccagtttcaaaggtttctttaaatcatcctcatcttcatcaccatcacaatactcatcatcaccaccctcatcactatcatcttctatgactgcaaacttcttatctttctcttcattatagaaagtttcaagatgagtatacgcatctatcattcgaattgtgtcattaatttgtagggcctcattgtacttcctcaaatgttctgcacaaacacgttctttgcgatttccttcttttgcagctgtgaaaaaatatattatgtaagtgaaataataagcatataaaccccctaaaattgtgccatggacttgaatatatgttactaactgcaaaactggcttcaccttggttttaaaatgggcaagttaaggctcaaaatgtgtcctgagctctgaaacagggcaagttttccaactcctagacttgctgcttgagttctgcctcagcaaaaacatgtagctgatgcacagagaaatggcatgaaaatatattagttgagtttgcctttggagacagagctattaaagtttatctcaagactctggagacaaagagaaaattggatagcattggaatctctctccttagaaaaggaattagaacatgtttattatgcttgtcctacagagaacacagaaattctatttggaactacttttgctttccattttttggggaatctgtgatatagtcatctaaaatcttggtataaacatgggataaactaagtgttaggtccaaacctaaattaccttttttttccatttgaatggcccattgttcatagggttgagttccaaaatctgacattggactcatttgacaataagtttgaatccttgtcattatttctagaagtttctctttaaatggatcctaaaaataaagtacacacttattcttatgtattcttattgttaaaggaataacattatctttgttagaataatttctaggttataataaatctgattcatctttgtttagacaaagtaacaggttagtgtcccatcacttgtctgtacatttatttttgtcagcttctcttttaagcctgccatcaagccacacccacaccaacaccctgttacctctgctggaatctccaacttaaaaggttaacaaaagtaaagttaatgaattatataaaccttgtatgttaaaggtaacttagaaaacacatattgcattaatgccacaattatttagaaagcttacagtgtaatttaagaaacattcctcctttgtaaaactggtttcagtattatttcgaccaaaataaaaagttgaagtagagtctgaataaagccagaaataaaggagtgcatgctatatgattccatttatataaagttcagaatcagtgaaaactcattttttgttttagaagtcaagatagtagtgattcctggggcatggtgactggaagggggagccaggagcttttaggatactggcagtgtgctgtctcttgatttggattttgtttacatatgtgtattcagtttaggaaaattcagcaatcagtacacatatgaatttgtacttttctgtatgtatgttatgcttcaaggtatataaaaaaattaaagtaagtttaaaaaatggcaaattcttttaaaaaatgtacctgagaaatttagttttaaaaatctttatgagtagaaacatgcatttaaaattatcaagtaaaaccaaataagtaacaaaaaaaggaaagtgaataaaatatattcaactgtgctagtgcagctggagtagatagcagtctttttcagaatttaaaaaaagagatatacggaggctagttactaacattggtttagtgcctactatatttcaagcattgttttatctactatgcatatttcatatcatttgatcccaacattcttattttcaatggtattatcaagtacatatggccagaatttgtaatgctttctaaattttacaaaataaagtattgacataatttactggccataatgtccaaattgactctcagtttattcttataattcctgaaaaattcatcagaaaagcatcattaaagtaaatatttcacttctttaccattgcactgttttcctaagaaagtaaatatgcaagtatgcaaattagataggattcccattatcattgccaaatgtaatttgatagcaacaaaatggctctgtggaatgtcagaaaatcaatcctggaattcacgaagaaaattaaaaaggctaaaacgaactgtcataacccctccagcttagttacacatccctctgcccatggcccctcactgtcccttttaactcatatgtacaaacaatgaataagctattcctcatgtaaattagaaaactaaaagaggtctagaggcgagaattcactgtagtgctttactgcctaacatcaattaaaaaaaaacctgaaacttgtttgctaaaatttttaaataatatttttcagatggtcagtataaaatagcctttgccatctttctactgaatgtagtattgtcaatcaatagatataaaacattaagcccatacttctctggttgcatctgcaatggcaaacttcttgcatggctcctgtatttggtttttcagttgatcaaggttttctttaacagttttaatagtaaatgcatcaagattggcacatagctggaaaagagacatttttcaatatttatgcaattatttttccctttcactttattcaacgtagaactctttttcatgtaaaaaatatgtagcattaaattgtagcataaatatgtggtataaaatttcatgaaagtaatatgtagcattgcttgctaaatatagcattttaacattgttttattatggatctcattaacccacaatcagcaacatttgtcctaatataggaaaaaggagcttctaaatcaagttggtgtaataacagagaaaaaggtgtattgatattcattccttaaattccattttccaagtggaaaactgacatggaaagagtataacaatttaccatcattgacagagaatgattttgagataaccatgttacatgaggcatatcaaaggtcaacttgacatccgtggatcatactaccaccttcttctacacataaagcaggcatctacacataaagctgggagcatccttagtcatgttccttgattattagattggaattagtccttaatcccagtaataaattatattttggagcctataattgcatctctgaatgttgtgtctactctacataatttgtattgaattcaacttaaagtaagggacttaaaattcaaatgcaattgccttggtaccaaaatacttcttgggctactctgatttacttaacactcaagattaacagtagcactgtatgtggtgttaccattagggggcagctgacaagctcatctttaaagatcttcatatccctatttccctttaatttgaattacctagattcctagaataacatatgaaggacagaaaatacgcagttttgaaactcatggagtaagactttattatgtgtgacaactagaaactttcatagtttatgcatatttctatatcaggtagatcattaaatttaaccataagagtagatgttcaaaagaaggcattctatttatctcaacttcccattaattatatcactctccatcatttttatgatatgattttgtgttattgatatttattaaggcatattagtattctgtagaagactgagtatatttattgtactaaagcaaacagatttcacttaactgatgatcacagcacttgaactcaatcttatttaataagaccaagaagtcctggcatttgttttagctttgctttcattggttatacataaaattatgacttacttttaaaatgtgttcttcagctttggcttgcttcgtggcccctccaacaccaggtgaagctgttagtcccagtatctgaggaaggggaatcactggtttgttttctttcttgagtctattgtttttcaacttctgcatcaaataatgcctcatgatgttattatacactgcttctttgttggtgtgatgacattcatcaatgataatgagggaaaagtcttaaaagaaaattcaaagagttcatttctccatatcagcacactacagtgagaaaatagctttagaccagtaattgagctgccttggggatgccttctcttgggcacgacacaagagcagtccactttcagtttttaggagggaaatctaactatactagcacctgtacacacagacgttcgtatatactaatcatgaaactccctgttagacattctccttctttaatagataagattcagaaagtttacagagctaaaaagcgttagatgtggaattcacaccctggcttattacaaaacaaatctcaggattttacttttgttctttaataaaatatttaattttaggttggtgaattttatttttattacatcaagtgaaaaacacactatttaaagagggaaaattttgccttgttttaacattgcatttagttattataaattatttttatttttttccattctttctcctaccttctcatcctataccccataaaagacaagatttgtatttttattctatgggaaagggaagcagatctaacaacattcaatagcaaataaaggaacttgtcagaataaatggaaagtccagcgagtgcttgccttaataatggtattcttatgcagaataaagtggtctaattaaaaacttactttttttgtttcctccaggaagtagaaggattttaataaaaccataagcaataaaagacaatttaagccacgaacatttaaaaaattaacaaatacagcctttgttatcatcaatattactattaatttttttaaaaaaataaacacttaaactgacctgacaattgaacaccagcatcttctccattttccaagtttaagagggagttttcaaggatttgagctgtactgataataatatcacaggacttgacaacttctggaaatgatattttcagttgggtatcaccacttaatccaataacacgataccatttcttcaaaaatggttggaactccttgcggaagagctgttcaactagcagtaccttaaaaaaatgtgaagattttttaaaagagagaaagttagtcgaagccaaaagagtgttgatcaaaggcctgtttggcatccagcatgaaaagaggtgtttacattatcagtgaatcaggcataacaacgttcccatcactcctttcattcatctgtcaataagcactgattatacccttgttaggtgtgggcatttatgtctgggacacaaagatatttaacatatggttgacaactctgaggaactctgtctagctgatcatacagaccaagactaaacaaagcaagacaaattattacaacacaatgtaataatgctcacctagaaacacacacaaagtgacagttaagagaagaagcaactgacgactcaaaaaaggggaatttgaaggaatttgaatctagtaagccatgagtcagtgaaaagataaactgaagctaaggttgaataagaaatacatttttaaatttgtagagcagtgccaggttataaagggctgcaaacatcaagcagagtattttacatgtagtataacagtttacaggatccctacaagttgtactgttgaagtgatttattcctgttgtttgttttggattagaccagaagcaacaggcccacaggaccggaagaatcagggaaccacaagtgaggagttagggcattgactaggagaacagatgtgaagtgaagaaatgagctgctggaatagctgtggtggctgagaaagaacaaacccgaaagtagacctggcaaaagaagtggaaacttcgggtccttctcagctgattctgtatgttataacatctgctgaaggtagctgggttgacacctcaatgctacacattactagtcactcaaaataccttctggattaggagaaaaaatataaggccatcttgaaggtcatatcctaggaagatttatgcaatggaagcccagcagtgtacaatatgggaaacagagagttggcaggaagagtttcaagggcaagcttcaaagaatgcccattatattattcactctccataattctaccagaaatgcaatcagtggttacctttctcctagtctgtagggtttgtgttattcatctttttacttgaggtaagtcccacttaggtgttaaataaggaatggctgatccccctggctaaagggaacagctaccttatgaagaacactggtttactttattatttagtggaaatgatggaggcttccaaaagtaggtgtctggggggctggaagaaggggtggggaagagttaaaatgaaatccataaattctaaggaagcaaagtggacttaaaatcagtaatcaagttggtgagtgaaagaacattaccttaccacaaggtggaaagggtagaaagagtaagaagagaaactttcatttagttctttttttttttcaaagtaaagtctctctaatctacctgttacaaacacgcttgagaagtttagaaaatgcagactcctaagtcccactcaagaattactgaatctagggacaatctctggggggcagaggcttgaaaccttcactttaatgacatttaagcctttaaaatttgagagtcacagctctgctcttctctctctcttccacaaagccgttcttgaatcattttctagaagtattctttccatttcatttatgcaagacagaaggcttctgaggaaaagaatggaaattaagtttagtggaaagagacagcatgatgcagagggaagaaagccctgaaaacagctactccagccacttacttctttgtaccttggacaaggtctcaatcatcttaatgctctcaatttccagattaataaaatgaggataatgttaacctattatagggttgtgaaaattaaatgaaatagaggatgctgtattgtcagtactaaaacttccacgatatttcaccaatccttttattctagaaggagggtgcagtggcaaaggaagaccagtggactcagaagataaaagttcgtgtctcatttctgctgtttcttggctggatgatccctgaattgccaattaaagtcttgaaacttcagttttctgatgggaaaaaatgagaataataaagactaccttatggggttgctgtgtagatttaatgagataatatatctgagagtgctttataaagtgcaataaaatattaattatcatattatcaacatatatctctcatctttcttctagactgtatatttcgtgaggacaagatctacatttgatttgtctttaaatacactcatgctgaatgatttaattaagaatctctgtattatggagtgacattgcaccacaaaattctgcccataaaaggtgagtcaaaaatcttcaaaagaagccgcaccttctgatgtacagaacaaaaagaagttgtcacaggagatagcagatgctggaaatcctgatactcgctctgggtggtgttgacttcctactgaaggacacagagaaagccagatgcaagtctgacatggctaattgggaggtgtgtggtcctcttggagccttttcttgagatgtgacagagtgcctgccaagactaatcaaacccaactgctacccacttctgctgaatcatatggggctgcattgcagcatctgaaggaacctgggatttatctctcatgatgttgaagccctagataggaaatggaaagtctgggaacacaggtggtgttttcatttctctctgcattcgaaggctataactttggaaaggacggaggaagggagatgaaagtaaatggtgttagagaacaggatttcttttttctagatcaagggtaacaataccttgttgttgggccaaacacaagattcaggttacttagacttactgggccagaggtgttctgactcaatcaaaaagaattaaaactgaaattaatttaaaattcaaaaagatggtatagtaaacaattatgacatagatggaagaattagtggagggatttctagtaattctaaggagaaaaacaatagaaaagcaataaggaattagagtcaagtccccaggtgtccacacaacaatgcagtgaatgtgaataattaatgaggataaattaatatttaaacatagccataaatgtgcattccgaagaatcatgtagatccaatgcaatgaaagattcctggctagaatatagcattgagaagagaagggaatattatagaaaggaagatgcatcagacacatacaaaaatatgagacttgaaaagatcaatagttaaagaaataaacctaagtatttgaatttaggctcagaaactgactgcacaaaaataaattaagaatgttctagtttaagagattttcaaataaaaaggaactgaggattttgattctatgacaaggtccagataagtctgtggatgccagaggcaaatgcggtcataagctgggtgtcatatctcatgtctcctacgctctgcactggtatgatcttatctgtagtattttgcccaactctggacaccgcatttaagagtgtcccagaaaaatgtctgaaggagtatgagcactaggaatgatgacaggtttagaaaccatgttatatggaaaacagttaaaggaactgtggacatttattccaaggaacaacaaaaaaaagtaacttaggagccacatgatgctgccttgtctatgtgaagggctgtcattaggctggagaattaggacttcgtgtggttgcagaggaaggaactctaaccggtgattgtgggattccagagaaacagatttggatgaatacaaatagggctttctaagagtgtcagtgtcttgttagtagggggacctccttgatattaggaagttaccctgcagaagtgagagaaccactctgcaaaggaagaaagctgaatctcgaagccccttttcaactctattagcctatgtccctgtgaccagataagggaaataaaggaagtagatgaattaaaactaactcctaggtgtgggggctgcatgctttggaggaggtggtattactcacaaagagacaggtaaatggggaagaggagcctttgggagggtagatggtgaggctgagtttgagaaaatggcagatgctcaaatggtttcaaaattatcagtttaagtagctttgaatccagttaacttggttcttttctttggatttggcacttaaaagcctccctggttatgttacttagtttcatgagttatgaaggtgaagagaaaggagcaggagaaagctagtatttaagagtaaaagcaggagtcattactaggccatatataatccaattgaaatttcagagcagggtagttattattttgttcattttgcagatgaagaaattaaagttagagaagttactaatttgtctaattcaaagtaccggtaggtagaaataggattcaaacctatttcatttaaaaaaataatatcctgtacaaagggaatacatatgcaagtctatcggcaaacaaatttgaatgtgtcaccattaccagcaaaataaataaaagtgttttaatagtaagtatacaagtataaaggagagctctttggacttagcagatgcacacaaaatgcatttggaactacatgataggaatcattcaaatcatggattctaagtactgaaaaacaggatgtaactaaaacttttagcataatagaaataaaaaatagaatattttacagtctactgcttttttttataaaggaatagataagaacagaaaaaagactttctgatcaaggaaaagtatgctcatttttattccataaaatagtaaatattcatatccccaatttgtatatttataaattaataaactgtcatttatctgaataaagctcaaatgactagattttgttttacggtgaagcagacatatttacttatgaagatggccttcaaataccctaagatataaattattgaaggaaaacttcagttgcatttaatgtaatatgtgtatattttatatatatatatgtatacttcttgagcattttaaaatctatttaacttgatgtagataccaaaccttcacttaattttatctccaaaccacattatatgtattctggagaaagaggacttgccatctttgactaagggtcaacagctaaagagaaagtaaaaaacaatatttgatccttgattccagtgatattttggggtcattcatattcatttgcaatgataaattagctagttaaccttaaagtatatctgggtaaatataacctgtgaccagataagggaaataaaggaagcagatgaatcaaaactaactcccaggtgttggggctacataagttatagctatttggtataatgtcctagttttattgaaaaatttctattttcaggttcatcacttagatattacatatacctaaaaaagattaaagataaaataaagagcttattttgacattactcttaattaaactaaacatgtgtgagtcaatgacacaaatgccatcatataaaagtttcagaataatacaatgaaaatgatcaactagtgttatgtgttctttgaataccttattgacaagaactataacttttccaggctcagatgcttttttcttcttgtctaagtgatccttggcaatgtaaacagccactctggtttttccactccctgtagggaggcagatgatgatattcttcccttccaaggctggctgggcaacttccatttggtaaggcctgagctggagttctggctccggggatgctcttgctgccacattctcttcatctgaagaaggttgaaaagaaaaataagagaagggacaacaaaataacagagcttaggaagcctgaaactgaacgtaggcctcttgtgctttaaactccttttcacatgtggtccaaaccaattcattttctcttttctgtaccaattaatgtctgctctctgcatctgcagaatacaacacaggctccctctcacagaaggagtctgggggtgtgggggtgcagagggagtcaactaattaagaggactggaaggagcaacatgggggagtgttttcacagagtgggtgaagccaaggcgaatttgtagaaagggctgtggtgcgggattggcaggtctagttgttaaggcatcagacttcccatttctttgtggagccactatgccctgcttgtttcacttagcccttccacctacaaaatcaagaggagctgagaaagttggaatcattagtcctcccaattccgtatttcccctttttttaattgcaaagaaggtattatggctgatactattttctttcgtttgtagaaactttatctgacaaccaaataccaaaaagcacacacacacacacacacacacacacacacacacacacagacaccctatctatctcaagttcctttttccatctgaggcaactacgttgtacagaagtgttatttagagagtagaggaaaaaactcttcctatgctagcctttaattggtaggttttccttgaaaggtaaaaataattttgttggtttaaactaaatcatgactacttttgccatttatttgtgaattgttatctttattacttccttatgtttatggctccacatattccaactttttctaaaatccaaagtataatatattaaaaatattttcaattaacatggattttaaatttaaaatactgataaaataagttctaacataaactttatgtatattaaaataaaattattataatatgtcttgttttagatagaatatattttatttagaagtgaccatattgacctatattaccaggggaaaaagatcaaaaaatgcatagcttataatgtgaaatgaagtaacataaatattataccaatttaaaagcccattttatgacttatataataagaagaaaaaatgaaataacagtatttatccatatttcatcacacatgaaataacttctttttcttatcaatgtttgcaataaaactaaactaacataatcccattaacttcaaaaaacttgctgatggctccatttcagcccctggataattctatttgagtgagttttaacttgttgtgatagtactatctgaacaggtaggaaaattcacaccaaataccacttaggatcatctactaacctggcaggaaatttgccttttgtatggatgagtaaaaacagatgcaatacatttaagctatcgttggatcatctgctgattcattcaatatgatttttatgaaaaactcatttaaaatcaccagcatttaaaatatacctttataagtttccatgcttgttttgaactctacaatatttacaatagttcatcttgtattatatttatgtaaggctctgatttatttaagaacaatgttagccctctgtagctttcatagactatcaaaaccatgatatttcacctctattaggatagtttgtcatctaacttttccaaaagagccagtatatttgcaaaggaagatgcattataaagtgtctaaacaaagacccagaaatttactactgctaaatttttgtttgatctaggaagtttgttaaaatataggaataaatcctctttgtttaatttcatctgagtttcatttttgcgtagattttaagaatactaataaaatgctccttccttcataatagttgcagaataaactattaaaagagtacattttaataataatttcccccatttttcatgcttactactatatccttgaataagaaatattacaaagagaaagatatagcaatttcctaagtctctttcccgagaatccagaaccaaatcaaatgagtaaaatattaatattactcatgcattctaatcatttattaagctgatacatttaagaagagcgagaatgttaaaaggactattgtgtttacaatttaacttcagaactgaagtcatgaggttttactgctacttaagtaggcatgtaccacaaatttattcttcagtcaatattgactggacacctattatatgccaggcactctcaataatatagttgttgtcctgaaggactttagagtctaggacactataccgctgttatgcacacaaaaatacctggttagacagatagctcaataatcttccatatttttgatttaagactaggagatttgataggtggccctaagtttaaaaagaagcacagtgtggatacaggaaaaaattagagttggattcaatgtgagactagcatccaaagaataaaagctgggtgagtgctaaatattcagcctgattcttgccttatcacatcctctgacacagggatggaagaatttatccacagaagcaatgaaaagagagttttctcttctgtgtcagcagaaggagagaactgggctggtatcaatgagccaggagccaatttcctttataaaagaaatgtttgggtttttgattgtttgttgtttgtttgtttttggctttctctgaaaagcataatcaattaaatgaaaatagcagttaaaatatgcacaagctttgaataacactgtgccctccctctacaacaagtattgattaaagaccttaaaattatattctaccatataaatggtcaaaaaagaaaatcaaataaggcttaaataataatattctattggaactacaccatgtggcaaatttcattctcacattgattttgacagctgagttattcttggagagaaaaggtctgtcactgcatgtgtttgaaatctacaaagtattcctttacctatggtatgtaaccacagaaaaatacaccattccagctggacaaatattaataggcattatcttgaaatagtaaggaaacactttctacatatcaggccaatatgtattgccaaaaacattgccactttttgagaggcaatatatctttctgaaaatgggaaacagaaaaaaaaaagcctctcataatataattagaatatttatactttaaaagtaccggtaatcatgtctactatggcataacacttccacaaaggaatataatatgattgttttgggtcacaccttatggcccatatatgacctctggaggaggaggaaggacatatagaatgaagtcccttttgatgtcaacttcaaagattaaaacacaattgcaaattctataatacttttcagtgcctcaatatgtgtttaacagttcaccaatttatctaaacctccttttgaattggtttctattttagcttataccaggcacttgtgggcaaggaatttcataattttaccatttcggaaattgactacccactaggcaaagtaattctttgctcctaagtactgatccatctagaacttcaagtggtgttcgttctgatgtgtttgtcttcaaatatgtatttgcctttgaaaatgtatttgcttttcaaaagtagattgcgttcagacttatcatgtgtttcatgccacattgaggactaaaaatcagcaaatacatttgttaacagctctaaataggcaagatgccctgcacatagaaggtacacattaaatatttattgaatgaatggatattattgaaaagcccttacttagacaaatgaaaattagcatgatctccaaaaacttaaaacaacctataatgatgttaaatattagctagattatctattttgagttctagcatagcatgtaatagaaatgttaattattaaattgaacaattttatgacaaggatagaaaaaacaaatataatccacagaaataagcacatggcaagaactcaataaacactgactgaattgaacagaaaatgaattcacccttttaaatgaagattaaagttgtgaatgacatttggtgaattgggtttcctcaaactaatttgttctaagggattcaggagtgtcattgtgataaaaggatatatgaaaaaagaggtgctacaatctaatttggaaagcatttaggattgatgacaatctttctataaactattttgccaccttaggcctcttgtggatatcaatttttataattcttctgacaatgcaggataatctgaattatataatatattcttaggggaaacaactcaatcacaaatgaagaataaagtaatgtgtttcttaatttatcatttttccaatgcttcttagctggccccttgcaaagcattttatttttgtttgtgatttgttcattttaattgtgaaatacttcaaacaggtaggcaaatatagaaaggtatgtaatagaaacccactaacccatcacctacatttaataatgttaacattttagcttagtagtcatcatggaaatatacactcaaagaaaagaaagaaacaatttgaaatctatcagactaacaaattggaaaactgataacaggaagtaataattaaggtgtggggaattaggaagaggcactctcatttattgctggtggaatatacaactgatattgaaagtaatttgggaaaaacctggtaaaattttcatttagtgaccgaaatattttgccaactctactcctattcaaaagatacttatacaaacttgacttcttttacttacatatgtaatttctagttagtcatacttctcttattgatagtatcaattttttatttaaaaagtattttaatttaaaaagtagaatttggaagtaaataaatgtaccaaattgaatacagtctatttaaatgcagtcaaattaattgaaacagatcccataaataaaatagatgacatgactctatggaatgtggcatatgccagaccagaaagatatgtactggatcaaaattagagagtttggttctaagagtttgtaagttacacttttaaagaaagtgaatggcaaagttccaaaactatttcactgtagaaaagaattgctttaattgcataaatacattagggagggtatgaacagcccccatgcttccactatatggcgtcttatttcacactttttaaggtttacacaacagttaggcagtacctgaatcacttcccatggtgcctgaatcactgcccatgttgctgttatgtccaagactttcatctaagcagctgacacttccttctgccaaacttgtgtctgattctgcaaaggaaaacattttaaaatatttttaaaatatttctgagaataaacgtattttaactgcacacctctacagcacacagtacatacagttcaattcaagtggggaaggcacacccagacaattatgaataaaaggtaagcgcttctggcaggctacattaagaaaaatccactatggatgagcagctgctgggtagtgattcaaatacatattacctacttaaagtactacacatccagtatgagagctaaagcaaattcctaagggtttataacttttattgcccttctacatgtaaatgttgcccaagaaaacactatttaggtttgatatgtcttttaaacaaaaaataatacatagaaacctttgaggtcttttcatttaaaatgatagggaattaataaagtacaaaaattaataaagtacctggatctactgatcagttatgaaaatgatagtttggtgataaacatagatgtaaaatctcaaagagaatttgttcaaaaagaatatcactaaagcctggcatcacagttgtactagaagctcatgtgaggttggaaataactgtttttctttactataattagattaagcctctatcaaagagttatggttaatatggatgaatagcagtgcacatccttcatttatgaatcctgacattctgttttcagaactcaggatcaattctttttgaaaaccttctttccctcagagaagaattcttttcttacagtttatttccaaacacttacacaacctcatcctcaagcaccagaactatcgttaaactggtaaaaataaagcaatggtggttactaatattggctttggaatcagaaggacttgcaaaatttgctattcactttgctctgaacctaacaagttccccttgttttaaagtgaggctaatcccacttacttcacagcccttgataatctttaagtaatattaggtacaacaagctcttggcacaggactttaattgctggcaattagaaaatgaaataaaaatcaagaaatgatatattcttaggataggagttccattagataatgttcttcttttaattaaaaatattttataatatttatacttagataatatttcatcctaaagcctcttaacacaccaatgaggtagctcttagctatttaaaactagtctgagtgtcatatttatggctggaaataaaaatggatgaaaaaatagacacatagtatgttttaataaaacttctctgaaaagagatgatatacaactcaaaactgcaaatatttcctttttccttaagtagttaattttttcaagtcagctatattaagatataatttacttactaaaaagattactttttatgtttatagtttgagaagtttgacaaatgtatacagttttgcaactttgaagaggttgacatatgtatacagttacgcaactaccatcacagttaaggtatttccagcaccccaaaagtctcctcaagcctctttgtagtaaatccctctggttatctaatctggtttctgttccacatcagacaaccagtggcaaccactgatctggtttctgttccaatagtttttccttttccaggatgtcatatgaatggattcatgcaatatgtagcctttatgtctgtcttttaaaacttagtttatagtaattgtgattcatctacgttgttgtgtgtattactaatttgttcctttttattgctgactagtattccactgagaatctgtgacatttacatctcccatccaatttggatgagcctatttagtttaagagctataacagaattacagccaatgccaatcaaatatgtaaggtatctttcttaaaaattaaaagtaagctgataagaaatttgtagaaaaattctcaatggacatacatactgtttaagtatattagcacaacataaatatactaatgtgaaaatactgtgcttatcagttgtcgcagattagttctaaaactcagatttgaggaatcccttatgatcacacgggaaaacctgtatatctcactgagagatttaaaatatggcacctcgcaattcccagaggtatgtcttgttagaagctcagaggcgaatgtgggatagaactgtcaagtagaagagcgttttgggcagatgtactgatgaaaagagaatatgatttgtaaggaaaaggcaaggtgtaaaatgagatggggaaaatgtcattgcaagagtaattctagatctagaaatataggctaagatttttgaggcaaaaaagtgaattttgacatgcttttcatttgctgttttaaatgtaatattgagaactgaagagaataccaaaattactgaaaaaatactaacaaatatctaaaatctaagactgtatcattaaattttccaagtataataaaaatgaaaattatatttgatttccacttcattttctaatcactagcagttaaactttaatcttaaacctacttcatctacatgtagagtcaagatttctcccaagctttgttctaacatccgtaagttttgggagggagctatttatgcaatgtgcacgaataattgatgaattgttttaaaagttgctacccaaaatagggtattattaataaagtctattatctggattattttgatctaacaaaccaatcaccaatgtgtcaggaagacactgaactcagagttttcacagatgtaatgtaaatttcattttaatctctcaacattctgtgtggtagatacatattatctcctgtttcataggtgagaaaccaaggcgctgagaggttaactgatatatccagatcacacagctacagtggggcagaatcctcatttctgaatccaagtccagtgttccagtgctttttccgctaacactaagcatggctgatgatttgggtgaagttttgtaaacacagtgttaactgaattaagagctgtggtggtggtgtttttcaacagcaagagacattttcattgtattgtcacatttctatccatcttgaaacagagcttatctttccaagaaaagaacttagagagatgattttgctttgctaacatttctggtttcattgatagattttcactaactttacatttaagtgtccacacctctttttaaacttttttctgcactcaaataaaaagaacacctctgttctcgttacataaaattaattgcagtaatcctgtagagattattatgaaaatgaaagtgaatatatggagctcgatttctttgtcattttaagggtatataaatcttcagtttctccacataaaaataattttgtttcctaggcagcaaattcttatgcattttgatatacgtttttgctttcatagaaatataagtaaaatttaataataaaagaaaatatattgtatttcttataatagggagaatgccttccccagagatcttcctcctgcattcactttaaaaaccgtattacacacaaacacacacacactcccaaaaaagtgagatcaagaaagtgtttgcgtgaagccaaaattaaaccgacctattgagtttaaatgccaagaatttctgaaattgatttatttaggtttatcttgttttgttctttgtatttttcaaactatgtcagtctggatttaagtcctaatgaataaagtcctgcgtttatgattttataagtagatcgcatggagttaattggaggcaggccttgctatgaaaaaaatttgtgctttggagtccaacagataagtctccagatcgaacgtagccacgacttacaagcaaattaaccttctgttttaaaaaatatatagagagagatagtagtctctattttctcacttattgtgagaatgattcggttagaccaagaaaatgaaactcgaagagaaacaaattttaaattctcattaaaagggctttgaatattgaagttatattgtataataagtttagttaagttttatataggtgtcatttcctctagggaaaatatcaaagctaactatgaaacagattagaagatggtagtaattgaactgttaaagaaaagcagttatttatatcaaaagctattggaatgaatgaaaattataaccatccagttaagagataggattttctttcataattttgtaaacaacacaaaaaagaacagccttgcctacaatgacagcaagtgcctaagaccagcccaaaagccatggaaaaaaaaagccttattttgcaatcacatcttgagtattttgctaataaggcagaaatattaactgaaatccaagaaatttcttatttaacatactctagaccttaaatactttaaaatatttttaaatcatttagaaaccaaaaatattgaactttaaaatattcaaaccaaaaaaaataaataaataaagcaagaggttgaaggcctttttagatctatttcaatgtaaagtctgccctctgctggaaaaagctaacatggcaagtagtggacaagtaggcattctttattcaaagagctaagctccattaggtaaaattcaaattgattcttgcttctattcctaccaggtagtacctcttctatttttggcctagaggcatttatcaccccacagaatatctttcgtttctttcccctggcttcagtctgccacacactatttttcccgaaaagtggttttgcattacagcaggaaacgcgaggggaaagggcctctgtgcatattgagaaagaacagcaccaactgctcctgttctcctgcgagtcagtggtgacaaggtctttagtccaatttcacttttcatggtaatttcatgtttattctagttctgaccttgtgatgcattttagcttcacctttgcagctatccccaccttccctccagtttcataatcctcacgcctggaaggtccaagctaccccgaaagcttgaaacatgtgtgcacgtttgggcacacacacaaagactgcatgggcttctcaagtgggcttacactcatactgctaataatatatatttcctttccttttgaaataacttaatcttttttgagaggaaatagatcacttttattttcagctctatgtatatggatctacacacacacgcacgcgcgcgcgcacacacacacacacacacactcacattttggtctgtcagattttcctctccgtgccagggaacatgtgttcccacagaatggagagaagccacctccacccaccttgcatattctctcctggatccaagcttctaggaaatgagttccccaacgagaaaaatcactctcctagagccacaggcccacatggctatccatggagctcctctgctcctgtttatagaatttctactgctgaaatgtttctaacagaattaaatttgaattgtgtgtaatgaggttggcttagattgtatcatctatgccctttagcctttgcacttaggttctaataaagagaggtagttattaaagcacaggttgcaaggataacaacacacaccagaatgacccattcattcactgccagtcagtaatggaggcaaaaagtcctagagtagagtcagttaatagtgagaagccaggtaaccacatgggaagtaaatcttggcaataacaaggtttggagacggcaaggtagaatgtgaattagaaacctctttggctggtaagcacttttcaggaaaggctgtaggagttaagcaaacttaagcagacatgaaagaatggagggagatacgaatacactaagggtgcccaggtaaatgttcaacaactggccctttggtggggggagacaggatttttaaaaggtttgtcaatttccatggtgtaaatattcacaccgtggccaatttccagcatgatgtcctgtgtggagctggaaagagatgtgcacactggggtcttacaagccagtaagatccagttccagcgctctgctagatatattcctctacctaaggactttcctacaatcatcatctgagatgatgcttgtacacacatgcattgtgctggcattgtataattatccaaatgataaatggtgtacttttaaaagtgtgtgtgtgtgagaaaaagcattgtaaaaattactgttagagaaactcgttaactttcactgatcttagaagtcttaaatcctaccgccctcctccacaaatgctcctctctcatcagactgttcctctgaacacattttgagctctcttgtgcttgtgcttttgctcatgatgcctctgaaacctgaaatgttgcctgccacttctatttacaaatccagcatagtgctctcaaggctcagatgaaatatctgatattcctcatctggtaagctttctctcgtcagtcttccttcttttacagatcttctctcttcatcctgtaatatagatcttgcatctcttttaccatggctagattacagtttctttgtggaggcatgtcacttgttttccttcattagagtataaactttttgagagtgaacgcaattcctcagtgcttggttctctcaatgatactgtattatctgaccaactcacctccttcttcctatttctctggcttctgacctcattcacatcctaaaattgtgaagggaagatctgatagtcaaaattaaaatcactgcttttgttaaaactctgctaaaaaaacagctttatgtttgtagtcataaacagatatcatgaaaataaatccaacatgtattaactgcacactggggagatttctttctgtctttctgtcataatatttatgtccccattcctgaggtatgaatggtaatcctcctaggactattatgcaactgtaagccatataactgacccagatacctcatgctaggtttcaaataaaatacaaacttacataatcctttaacaagtaccaatatcagtgtcagcatcagcatctctctctttctctcagctcaaattaatatgtgtcttttggattgcctcagtagtactgctagttctcaataattaatgataactaagtttagaaaaattaaaaagtaaaggagtgctcttacttcaaaccagtcctgatatagcatgaatgattctgaaacagtcttattgtaaactactgtatcaattatttttttccacttaggtttcaaatgctatggttttatttctagagattctaaaaatctctagatttctagaggttagtgctacagaacattattctggtcctcaagtgcaaggataaattttgtggcacttttacagaaattagtatagaccaaatctaagattggactttagtctataaaaaggcaaaacaaaacaacaacaaaaaaagtgctataacagattggaccagggagaagaaggctgttttgtaaaggtcaatttttaaacccctcctacagaacatgatctatgcaaaatatatccacaatatattccaaagcataatgtcaccggataaacctaaggagtggaacatatggggaaatatgagaaagaaggtattaaagtctgaaaacaagcaggttggtaagctcattagctggggtggaattttaaaatcttcacgtgaacgaatatataaatcaaaatatacacatgcaatcacagtcatgcgcactgtatattcacacatggcacactctacagttacattataatctttcacgctgaaacagtgaaattccattggctttataaatgtaaaggcgccctctgctggccaatctgaggcatttgcattttctagttttcacaatagggcagctgtaacacaatgattaaagaagtttggggggattttctgctccattctgcataaaagtttataccaaatgcaataaagttgacttagttttaaatgtcacttaatttcctttgattttattgtaatgcattaattcctaaaatagtataatgaaaaaaggttaatgtgaagtaactattcacttgttttgacaaagcagcagtagcagacaaagactgactgcacaactaatttaactgttcgcttttagaagtaaaatatttgctatatagaagtcaattatttgctataattaaaatgcttttaatagaaaatgaaagcaggcttagtgtctctctgatgtttcctagggaaatctgatctagagaaacaccaaagttttgcagttatcttttgttataagacgaccagtgacttcagaaagcagaactatagcatccagcattaaattgccattaatagtctgagaactgttcaaattttgtttagaaattgttttggtaatttggaaaagggcaaataaaaaattgatatatcaattactaaccacttttttaatgagaagcaattgatttgtaaacataggtgggaggaggaaaaaggacacatatcaacccgcaagtttggagatatgatgaaatcactctctagaacaatccactagagaactctgatatgtcacctctagtgccaaagggatatgtgtttaaaattagtttcaaggtgggccactgttactgatggtagtgtgtcttatccatcagatgtgttaaggggtaaaaggtgctaaaacacacacacacacataatctttgcattaaagctataaataattaatatttgcatgcactaagactactatgcactgagaaaatatttgataaactggttcagaaataataattataaatatcttaatttaaaattacaaataatttgagtcttttctttatacacataaaaatcatatttacagactttgtgacaagtttttttcagtgctatcttggcaactatttgaaactttaacctaatataatggaattcaaaataaagactaaacattatcaatatcaagaagatacacaaaacaaaactacacaaatgcatattagaagctatggagcactttcacatttaccttgattgttacttctgtcagaaaatgcctatgcaggcaaaacccttccatagtaaattctgcaacaaaaacttcaatcaaaagaactcaataatttctctggactaatggtactttataagttattaatatcagtaattcttagtccttaagataacaaggaaacaaacagatacctggaatgacagcagcagtctaaagcaaaggtctgaagcaaacacactacattttcataaataagtgactctttgctagtgctctggaaagggccagaatggattaaactaacctgctttcaaatccacatgagaaatccagatatcataaagaacctatggactagaagaccattaagatgtttgtgaattggatggatcctcggattactgtgcagtttactgtatactcttacatgctctcagactattatatattttaatactctgtactactctttcatggcacttactaaaagtgtagctatacagttactactgctgggccgacacctccctcagtggaaagctccatgggggctgaagtcatttctttttttttgagacggagtttttttgttcttattgctcaggctggagtgcaatggtgcaatcttggctcactgcaacctctgcctcttgggttcaagtgattcccctgcctcagccttccaagtagctgggattacaggcatctgccaccatgctcggctaagtttttgtatttttaatacagatagggcttcaccatggtggtcaggctggtcttgaactcctggcctcaggtgatccacccgcctcgtcctcccaaagtcctgggattacaggtgtgagccaccacgcctggcctgactcatttactcttaattatctcttaccatcacaatctccagatagagtcatattaggctccatggccatgaagccatttctgttatgttcctgagttcacagtatacaacaaggtgcctggcacatgataggagtttggaaaatagttgttaaatgaaagaagtgaaaggaagagagggaaggaagttagggtgaaaggaagggaagggaaggagggagatagagaggaaggaacccaagaggaaaaaaaaaaataaaaagcttttctgtcccctaatatcattattaaaatttttttcacaagatacatctttaagttttatactaagaagtaaaaatttaaaaaaatttaaaactttgcctttaattttgttcactagaagttcagagcagattaactacaagctaatgcaatgcattagtctggtaatctttgatgataaaccctcatttaagatgcagggtcatctctcagcagtagctccatcttcccttctttctagtgtggatttacagaaaatggccagtaactcatagagatgtcgagtagcttgtaaaggacatttattaaaacatgaaaactccacactcagatagtgaattttggcattcctatagaatcatgatttctaaaggaaggtgcagctgctcaaatgaaaaacaacaacaacaacaaaaaaaactatcctgtataagctttgctattagcagcagcagcagcaccagagtttatgagaaaggtggaatcgcattacattaaaaaacaaacagcagctcaagcctataatcccagcactttgggaggccaaggcaggaggattccttgagcccaggagtttccagacaagtcttgacaacatggtgaaaccccattctctaaaaaaaatacaaaaattagctgggtatggtggcgcacgcccgtgatgccagctacttgggagactgaggtgggaggatcacttgcgcctgggaggtcaaggctgcagtgagctgtgtttgtgccactgtactccagcctgggcgacagagagacagagcaagaccctgtccccgcctgcccccagaacccccaaaaaaagaaaaagagaaaaatccacaaacaggctaaaaagcaagccaactgtgaaaaaaattggtactatttatgacaatgaattgatatcttatatacttagatagttcatataagtcagcaaaaagaagatgaataccctaatagaaaagtgaattttaaaagtattgataattaacaaaacaaagagaatgaatttgtgaaattctttttcagcagaaatatgaaaatgtaaattcaaataacgaaataccatttttaatagcagccaaattgaaaagattgaacatgataatattattcattctcgtagaagagaattcagggaaataagcactcatatcccatactcttggagaacatgtaaattggtacaagttcctggagtgagatttgacattaagtatcaaatgtgttaaaatagtataaatcatttgacccagaaattccaattatataatatgtttttaaaaagcaaactgtgacataagtacaaagagagctatcgaggcattatttaaatgttcaacaattggtcaattaatcatactgcatccaaatggtgggaccattatttagtcattaaaaaccaggctgtagaagaatatttaatgaacataagagaaatgacactatatatacacattcaggtatgtaaaaagcccagaagcacacatacccaaatgttaagtgtaatatccacattctgggaatattggtgacttctttgtgtgtttctgtgtattacagatttcttgcaatgcatgcatattacttatctaagtacaaaataacaaggccaggcggagtggctcatgcctgtaatcccagcactttgggaggccgagtgggggggatcacctgaggtcaggagttcaagacaatcctggccaacatggtgaaaccctgtctctactaaaaatacaaaaattagccgggcatggtggtgggtgcctgtaatcccagctacttgggaggctgaggcaggagaatcacttgaacccgggaggtgaaggatgcagtgagccaagagcatgccactgcactccagcctgtgtgactgagtgagattccatctccaaaaataaaataaaataaaataaaatgaaattaaaaaaataaaaataataaactttgcagtggtgtgctagagttagtttatatgggctcacaggagctaactggtaacttttcaggaattttctgagtttttaaccacagccattacaaaaattaaattgtataaacttaccataaaagaaattattttcaggcaaaggttgtaagtatttaaaactcatcacctaatcatttaactatcatctttgatctggaggctatctccgtcttttgcatctgtacggtgggaatgctgtataaagatgtgccactgcacagctcttcccagctttgtgttcagtgatcttatgttggaagcttgaaataagcctgaatgagaatatttaaaccacagagactagcaaatgctacaaactagggctttttcttttccccagagttacttgttacattcaccagcacaccacaggctttaagcaactatttcttgtgaaaacagaataagtccttttggcagagaaggggagaggtggattctcctatcacgagcagattagaaagggaaaaaataattaaataatttgtttctgccagggctgtttcagtatcaaaaaggtggacatggtagtcttcagtcctcaccgattagttaatgcaattcaagccaaccctagttcagcatctgttcatcttcctttttatagctttgattttaatttttacgacacagttgaacctctctgagccatcccagtttaaaccagagaaaaaaagcaatgaatctattttattttcagggttttgggtgaattaaattgactgatctatttataagtactttgaaaaccaggaaatataaggcattcttatacttatcttacaatgactatggatttcttataaattaaaattagatgcaattgtgttcatatttataacacatcgatattggattagttttagaaagcattttggccaagaattattttaatttaatctcctctaaaaatattattttaatataaatgtttactaaccttaatgcccacattttctccctctgattaataggttctgcccagttggtttttctggaagtagtaattactgtattaaagtacgtatgtgtttcaagtacctgaaactacagaagaatctgcaaaagatgattctgatgagttattctccatgccccagacctccttctccagatttggctgaactgtggttgaaagaagttgctcttccacttgaggaccatcaacttgtgataaattctcaatctctgtgaataacagtattagaatgcaaatcatagtgccatacaagtttttgtagagcatacataactgttattgttattttgaaaacaaactagaggttcctaatagagattgcctgaatatatttaaatactttgaagttctgaatagaatgtaaattgtattgcaatgcaagattttatacaatataaatagctgttattgttattttgaaaacaaaatggagagcccgcaatagagattgctttaatatattttaatatgttgacatttcgaaaggcttagaatgtgcttttgttatggcaaggtacttttaattttaatatggacacaacgagtagttctttgtaatgattagactgtagctaaaaaaacaatataagcattatgctaatcacaagaaaagtgatttcctgtctgaccgtcatgtttaggaagtaagtcacttattcagtgacacaaagttacatttaaggctgaattaatgaaaatgcaaatttggtagttttctttagctttgctcttgccattttgtttcctcactgtgtgttctgcacgagacgtacatctgctttaatgtcagcctatattcatgtattctgaatttctggggatttttaaaacatttaatgaaatattttgtgcccctcttttcttctttcctccattcctcacttccagcttttcttacttcaactacatgtaatgggtattttattaagggcttatgtgggttaaaaagaaaatcaagagtttttgcctttatgaagctgcaatctgtcagagaagactgatgccataaggaaaattttctaacgtatcattttttattatctcatcttaaagaacccagtgaaaatgtgccccactttgtatggaaaatttcctaaagaaaactgttgtgactttggacaagaagaaaacttggcaatgtttgcagttagatattaagtacattagggactattataatagttaatttattttgcactcacaatataaatactttacatacattaagttatttaagtctcaaaataaacctagatggtaagtaatattattgtctccattttactgaggtgataagtaatattattatctccattttactgaggagtaaactgaggcatagagaagtcgagaacctggccaaaggtcacacattcaaggaaggagcctggatttgataagcatcaggatccgatatgtatcaggacccagagtctaagctcctacagtagtctgtttatgctgccataataaaacaccatcaactgagtggctgaaacaacagacacttcttttctcacagttctgggcactggaagtccaagatcaaggtgacagcagggtcaatgtctgatgaggactctctccttgatttgcagatggccacgttctccctgcgtcctcacacggttaagagagagaaagagacagatgtttctctttttctctttcttcctcttcttaaaaggccacaattctatcagattaaggccccattcttatgattcatttaatcttttttttttttttttgagacggagtcttgctctgacacccaggccagagtgcagtggcatgatctcggctcactgcaacctcagcctcctggttcaagtgattcttctgcctcagccttccaagtagctgggattatagctgcatgccaccaccccagctaatttttgtattcttagtagagatgcggtttcgccatgttggccaggctggtctcaaactcctgacctcaggtgatccacccgtcttggcctcccaaagtgctgggattacaggcgtgagccaccacgcttggcctggctcatttaatcttaactatctcctactatcactgtctccagatagagtcatattaggttccaacatatgagtattaggaggacaaaattccatctgtagcattttaccattggcttcccaaaattcatatctttactacatacaaaatacattcatctcatctcatcagcccaagtgccttaactcactgaagcatgaactctaagtctaaagtcaaaagtctcacctaaacattgtccaaatcagacgtagatgagactagaggtgtgattcatgataaggcaaattcatcaccagctgtgaacttgtgaaaccagttgagctacatgtttcttttccataatacaatggtgggacaggcataggatggacgtcttattccaaaaaggagatataggaaagaaagcaagggtgatgggtcccaagcaaatccaaaacttattaaggtaaattctgtcacatcttaaggcttataaggcttgagaatagctctgtttggtttgatgctctgccttccaggtccacggaatggcaggttctagggctctgcaagacagcctgctctctctaagggctccatccacacagctttctgtgaggatagctctgcttctgagacactaggcagggtcatcctgagggctcactaaaaccagagagacagttttgccctttgaaaccaaaaaggaaactgccttggcctctgggtctgtggtggaagtggcaaccctgatgacttctgtatcacttttgggggcattctttcctttccctgaagaatagtacacattcacagccaaatagctctatggtctggttctgtagaatccagaaagtccagtatccttttctcattctgtcctgctttctctgtctccttcagttcaaactggaagtgtatttgctggtataatatatctctactcctaccttctgctgaaatggctgattaagtccatcagtagcacccatgatcttgttatcaattggttgttctctttataacacaatttctcattttttgccatatggataggctgagaattttccagatatttaaattttggttcctttttgcataacaactccttcaattaatttctcttcttttgcattttactataagcagttaggggaaatcaagctgctccttcagcattttgctaagaaattttctcagccaaatatccaaatccattacttgtgagatcaagttttatcccattttataacaaggatcacctttcttccagtttccaatgacatttttctcatttctctctgtgacctcaccagaatcaccctgaacacccatatttctaccattcacccaaaactcttacagtctctatcaattacccagttccaaagccacttccacacgtttaggtgtttgttacagcagcaccccactttttacagcaaagttttcattagttagggtcaccagaacaaaactgcaatgattataattaattaatagttaactttcaatttgtctttcatatgatatttttggaaacataggatgcatactacgaaaagaaaaataagatagcagtttaagtgagatttacaaataatgtaggagaaggagctataaaatgttatgttattactattattgaatgctgtttaaaatctcacattaggtaaggttgagatatattgacaaaacaatccttttatcaaatgcttaatacattgcttaaaatgtataaaaatgttcagaagaatatgcagcagattttttataaccactaaaatactttcttccaatgtatttgtgtatatttaatgttacataatcttgataaaatttctggtagtcatattgtttttaaaataaggtagtagaaagagtgttggttggatgaaaaatggtctttgatcagttgatattttcccaggcatcaatttcctcatttgttaaggtgataaaatagatgatctatcacatatgttccactcttaaaattttgattctaaaaatcttggtgtttagcattgtgtctttctgctttattgaattctcaatcactaggcagaatttgaagaatcttcctcagtaaaattacaaatacctgcattgctttctgagcaatcagagcctgttaactcttggacaagttcattgtttcctgtttgacgaagaacattcagaaatgcagagaaccagttttctttctgcacaatcctttttagtagctctcttacacctgattcatttccattgttttctgcagcagcaatctgttgtaagagaaaattagaattaagtaagatcaaacatcttctgaataaccttaaacaggaaataccctttagaaaaactgagcaattaagcataagtataaataaaggcttacattgaaacattgaagaaaatagcaatgttacctgtagcaattctgaagtcggcagggaaaaaaatctccgggacaacaacaacaacaacaacaaaaatctctggaccaagtgtccttttaaatatgaaccattttttttaaaagctattgaattattcaaacctgacacctagaaaataaattttacctcagccattcctgaataaaggatagaagagaaagtatctttagtctgcagccatgttatgtctattttcaccaatttctttctgtatatctagggctggctatattttttcaatctatggagtctgtaaatgggaaatcaaacatttcttatctcctttcttcatgattatcattatgaaataagtaattactactgcagatttatattttttcctatgtaatatttgcatagttgattattactataatcaatttttctcaaatttgtgtttttttaatgttatgggaaatttattgttatatcttttttttggaaatatggggcagaattatttttatatccattcattagagtctttagccttcttttattttctcttttagattagtaaatttcttttaaatgtggatcttttgtgtaatcattgtcacagtgcatttccctaggtcctaatatagcaataaggatttggaggaaagagtaactcaagccatgtttagacatgaaagaagttaggcaggacatcattagctttctgtggcattaggcaatttacttcatctccctagaccttggttacaatatgtggttacaaggcagctgaaaagaaatttcagagtttctatatcttagctgcatgttagaaacaaccgtaaagccttaaaaaatactgatgtctaggaaacacccctaaaagattatgatttattttgtctatgttaggaactcagatattaaagaaaaagtaaaacatctcatgtgattctatcagcctcccagataagaaatattgactttgatattatcaaaggtccttctcaacatttgccaatcttccacatgtatcatttggattgtttagttctttcctacaaatttatgtattttctagttctataaatatattccataaccttttatgtcagaaatttgttaacatttttggaacaatgtctggcactaattcagtgttagaactattatggatgattgggaagagttattgttacaaacacctcacctgcacaagcacatacagcatggtctctacccaagggatatttccgtcttagcatctagtagttaagcatgctgttctagggaacttgaatatattaacccagcagcccagaaataggtaccaatattaactcatttacagatcagaaatccgaggcacagagatgtttaggtacctctctgaggtcacaaagtgagtaagtggcagaagtagaatttgatcccaggcagttgaatttagaggctgaatcctgccttcttgaactataattatagcttataattttctccaattttaaattcattttctggcaagaagtggttaaaaataactatttgaactcagtaaatttcaagtgaattcagtccatgtcacccacaacattttctaagcagatttttgctcattttttaccatttttttctagctctcttagtctcctaatggaaattctttggcttccctgatgttgtaacatctttattatcatctgctaatttaacaagtaattgctatagatgtaaataagactggtttcagtgtcttcttttaactcagccattctcatattttattaccccatcctttaatcagctttaaatatatttgactgaagcaatcaggaaggatttccttaaaaagaaccagtgaggcaacaaatgctgttattaaaaatccctaagcatattctatccacaaaattttcttcaaccactattctattaagtcaacttttactgtggaatcatatttttcaagctttctttgccgttattgagtccaagcatataaggatcatgatgtcattatttcctaaacatattcttacaatttgaatgtggaactacatatatctgtgcaattttagcagcctcatcaagatgctgaatttttaagaaatcttctcagttttggtgctggaaagtacatcagctccctttgaagcaattatataattttaaaaatttaatatgttctcctaaaacattgtaaagatattgatcccaatatgtaaacacaattacagaaattcgtgggaggtgaatatttacatttgagactgcaacaagtcataaaacaattctcacccatgcccctcccccactcgaagttttctctgtgaagttaaaaatggatggatgttttcactatgtagtctattaatacattgttaactaatttatgaaatacgaaataaaattaatttggtaataatacaactcaatgctttcatattctaaattctttgatatgttttttctttccaacagaaatcagtgaagaaaccaatgacatttccataaagcactggcttaccaacacaattgtacagtttaatgaaaatgttttcttccctttataataaccttagatagctatttaaatataatggtgatttttttaacccagcagagttcaactctcagataaaagtaaatcaggaggcaaaacctgtatgttaaaaaagaattttaaagaaccagtttcccacaaaaagttaatgtcttaacccaatgaatatttattgtcacattgacatagctaatttcttattcatacttttttttttgcagatgaaattcttatctttcctaatttgccagacaatacaatgttcctggggagattgacttgggtgctcaacttcatgttgggagaactggactgttcttaggtggactagtcatggcatctctggttcttctgtgtaaatggaaggtgtgtggagtctccaggactacagatgcattgtgttctgaactggccagggatgaaacatgcatctctctttagctgttcagcttgattattaagacactatggaaatgtttatatgatcactttcgttcccagagttcatgactgcctaaattgatgggtgtgccaagttgtaacttagttataactaagatgtaacaatgccaaattgtaacttagcatcctaaaagaggagcaaggcagtacaggggtacccccttaccattaaggattgctttattataatgattgataaaatggcatatatttattgctgaaactctagtatttagaatagtcccttgtatacagtagacattcttctttccttccttcctttcttccttccttccctccctccctccctccctccctccctcctttctttctttctttcttttctttctttctttctttctttctttctttctttctttctttctttctttctttctttctttctttctttttctttctctctttcttattagatggagtctcgctctgtcaccagggtggagtgcagtggcgccatctcagctcactgcaagctccgcctcccaggttcatgccattctcctgcctcagcctcccgagtaactgggactacaggctcccaccaccacacccagctaatttttttgtatttttagtagagacggagttttaccgtgttagccaggatggtctccatctcctgacctcgagagccaccctcctcggcctcccaaagtgctgggattacaggcgtaagccaccatgactggcctacagtagacattcttttatcaacactaattaacactacaacacaacttcacgaaaggacaaaacagtctctgtgtttttctcctatcttttcaccactagcatggcatccggcacaaagatgccactcaataaattcaaactgaatgaatgagtgaatgaatgaataagtttttgggtacttgctggacacaaacctatgtataaagtcattttcagaaggcctgctgtaattacgggcaggggctaggaaatggggtgggaatcctaaattaaaataatagatcaagtagaaaatgtctatggggaaacagaaaaagaatgaaaatacaagaccattttatagaagtcttgattacttagttaaatgctattttaagccttcaaaaaagcaaatttggaaatcttattttcatcattcatccattctctaacgcctggcaacacaattcaatacgtcatgtgttttcaacgcttattccagacactttcagaaataaattcaattagtctatcaatcaagtaatcaatgcttactaaacaccaaccctctacctaatcctagttaggttctgggatgaaagaggtaatttctttttcaaatcagtataatctagggactttaagaagtatatctcaattgcgacatggggaatttacctcaatctctcaaacttaaatttacacagaaatgtaaccagatgaatggttacaaaagtcaacaccattatcatatcaaatagctctgatttataagctttttcataaacactatttctgatttgatgttgactaaaatactgtgagaaattttatgatgtccattttcacaggtaaatgtagcatcagggaacttcagtaatttggcccaaagtaacgcatatagtaagaagccaagatggacctcaaatccatgtgttccccttctacagtcttatcacactttgctgctgtaagataaacatttgtcaatgaccaccacctcaatatagattattctaccaaacttaatgcttccgtctcattgtccaccatatcttagttttggaactgataatacatgtaaatgatgcacacaaaaattattccacactctcacagagaaactattgcttcctagagagcctcaaatttatagctgctcagtcttttggggcctcctttgaaatgtgaatcagagggagaatttgggttgttttggccttaactgctaccagtacacaaaagtcccgttactctatatcttctttgtgtcaaatcccttgcattactgctagctgcctccaagcttgccagaatcaagaacttggataaaatctagctggcggaaattcaatccaggcaagacaaaagtgatgctgataggcagaagtatttagagtaaatagggagaagtgctgtttcgctggcaatcgggacatcatacccaccaaacataaacagctttgtggtgttactggactctgttgcttctggacttctaacagctactgtggctggaaatgccatcttccatctccagctggcttgaaggctgcatactttcttccaaattaagattctgccacagtgatgtacacatttgtcatatccagctggactactataatgcgttctagctggttctcaatacacaaaacgacataaacattacagacaacagtgcaaagtaatttacttgttgggaaaactggccatcaaaattagatgcatgtttgggtctttggacaggccctgtgtctgtcaagtctacaaaagatcactaactttattcactaaagactaaattgcatcataggctatagcaaatcaatcaaatgcccagaagtttgtatgaatatacaaacaatggatgacccaaaagagagagagagaaaaaaaccatgtgaaaatcatagagtggtgtagacaaagcctttgacttttagtcatggctttatttgtctacatgtcttccaaaacaagacttttgacttacgagcctgaataagtcacattcaaacaggtcagcatttatacacatcacagtacatcttcacttatcaaaaaataattcatatcacattcaatgtaaagtcatcagtaaaattcgccctgtcaaaatgctaccttaagaaaaatgagtttcttcactaacatgaaaaactgaaactagcaacacattctttcaatgaattgtttctaaattttgattctcaaagaatgttgaaactttgattaaagaaaaagggtgtgtgtgtgtgtgtgtgtgtgtgtgtgtgtgtgattgcaatttacccatttgggctaagactaaatggcacaaagtgtaatgtagggcaaagattggaaaactttttctctaaaatgccagataataaatatttttggctttaagggcacacagtctccatccaattgcctttggagtagaaaagcagccacaagcaatatgtaaacaaacgagcatgactgtgttccaataaaactttatgaacactgaaaattaaaaattgaaaaatctgaagaccattcttagcctgtgggcctgaaaaaaacagtagcaggcttgatttagcccatgggccgtagtttactaacccctgctccatggaactacattaaataagaaaaacattcaacactatcacaagctaaattcttagctctgccactgtttttcctgggagaccttggacaaattatttaacctgcctcaggtttctcatctgtaaaatggagttaataacattaggagcctcagtgggttactctgaacatgaactgtagtaatacattttgaaaatgataccaactgcacatagtaagtgttcaataaaagttacctgttaatacacattacgattctagagttaactcctttttacttcagtgaaaacattagaaaagtagttcttttgtgtttaaatttttaaaattgtcttaaagtgcctagatgttgtcttctcaaaggaagaaactagatttgcccaaagaggtcaagcacatttggaaaggggcaaacgcacaaggaagcctgctttgcaaaatctgcctaaaaggctagctccatctgaacagacacctacccggtttctgtcttcaattgtcaacagttcctcctccatgcacttatccaagacgtctctaactagaagcttgtccaccagagtgggctgaaggaggttcagcagttggagatattcatcatgagcgttctcaaacgatggagagggcaagtccgtgagctcagggttcatgtagcgggcggccagagggctgccggttctccggagggcctccacgaattcccgagtccaaccaaggtgccagactcccttctccaaggtgctcagcagcagttcaactgcctgcatgttcccggaggtggcgactgtcctctgaatctgctccttcacctctgcaggcagaaaggtcaggtagtccagcacaggctccacctggatgtacattttcaccctggccctgaagcacgagatgagatagcggaaattctcgtctgtggaatacccattcgacatctttctttctcagagaagggagagggttctcccaagcagatggtgctgttgtctgcgggacaggtgaaatgtgcgtgccgctgtccgctgcccacttagagaagcagggtctaccgctctgtgcctgacaatgacgaggttgtccacagggctctcaggccggcgcgcggggctgcactcgcacctgggcaggtgggcaggcgggcaggtgggcagcggggcggcgcgcggggccgcggcaggcaggtgcggccggcaggcgcggcactttggactctgcggtgtgcgcctggggtcccggaccggggcgatcctgctgcacactcgggtaggagctttgagtccagctttctgtcaggcagttcttacagagtttgcctgactttggtttctgtttcgat

SEQ ID NO: 1759 - DNA, 34915 bp, Homo sapiens
  source 1..34915: mol_type = genomic DNA
aggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtgagaggcggggaggagagtcttggcgcagggcgggaggtagggcacgcagctgggctacgggggcggcgatgctgttgggggcgacagacgcccagtctgggaaaccttcggtccactttgccgcgccaaagattaaacccgacctgggctcgcaaatcaaccaggagaaagtggtgttctgggtcctctcttgccgcttgcctgtggccgtgtacgggtcctcgggagcgcccgggtcccacccccgtgaaatggcggtgccagagctttgtgtcgagtttgattctttccgggaaagtaccgcggctccgctggtctgtttgataataaacaaaacatttcccgaaatgcatttcctcaatctggtgaataggcgcccagtcccacgggggagtgagctaagtgtggccaggatttctctgccctcaggattcatacaggccaataaaaaatgacagtcggagtgactgaagcataattgtcagttctcgaggtttactaagcctgcttcagggcgcatccgggaaaaacgtgagccacaaacacgtctgtgactggttttccagaggttttcaggaggtggggcaggaaggcagtaaggcaaatagttctgtgagaatttagttagtgcccaagaaatctgtattttaagataccatgagtgtcttgaagagaaaaagagagtaaagggagtcagttatgcagatgcctctgggtagatggagtcttgactttgttttgcacctgagaagataagcttgtaattgacatggtcagtgtggaaggcctgaactagtttttcagattaactttggaatgccatttgttgagaggagaggtccattcacattgttggggggcttagaattttatttttggtttacttaactacctacttttttcccaaagaaataatcatgttcaaaactcaatgaaatgttatctcaatgagattgtaatgttgctcagtctttcagaagtcataaaaatagtcatactttttaaactagtaaatgcaattctaggacccaagactaagaaaactgtccaaaatatgggaagacatttttatttatacttttttttttttttttttgagacagcctgttgcccaggctggtgtgcagaggcgtgatctcagctcactgcaacctctgcctcccaggttcaggcgattctcctgcctcagcctcttgagtagctggaattacaggtgcacgccaccacatccggctattttttgtatttctagtagagatggggttttgccatgttggccaggctggtctcgaactcctgacctcaaacaatccacttcagcctcccaaagtgctgggattacaggtgtgagccaccacgcccgatctatttatgttttagactttagttttaggaactagacttaggttgtagacctgaagttacagttggcatccccttgtttatgggagaccagcaaagaattgacttatgaatgatctgtcagggtagcccttcgcagatggctgagtctttttatccttccttggggatttggctgaagcataatgctagtaacagccattcgtttggaagagggtgttgcagtcacttggcctctgggcttaactaacttcccttttgcgtaagaaagttgggagaggtcctgagatttttttttttcttttacaaaaataataaaagaaaaatacaaaggcagggcgtcaccaggctaatttgctgaaattcttcatacttacttgggatgcatgggggaatggcaactattacaaggttgatagagagtgagaggtaattttgtagtgaggaggggtacccaaagagaatcagggctagcatcccagtgcaggagtccaggtggtctgtgagcctgcaagtgagttcaaaatactttacctgttggcttaggaaaccatatacctgtgtggtacatgatatcctatttctcaaacttttccacaaatatgtagtatacttttcctaggatgtgggtactagggtcctggtgcatcccatagtaatttctttgaagtcttttgtttatgaaaaacttgcattaaactcatgtttggtttgatgtgaaaaaagctttcccagaattttcatataaaattgacattccaggagggtgtgcattaagaaattaatttaaaattaggttagcggacaggtggcaagatataatttataggcatttatcatttcttaagctcttagctgtgtgccaggcagtaatctaagtgttttaaaggtataaactcattaagctttcagagcagtgtagatactgttatgcttagttaacagacaaggaaactgagcaacggagagatcaagtaacttgcctgaggctgtataggccagtccgtggaggagtgggaagtcaaatcctgagtctggactaatagccttggggcttaaccagactagactgttttcccaaaggccaaacaatttaaattcctgattgtccacttgtatgttaagggcctaattatcagtatctttcagttaactgtgagcccaaaaatatctgagaccggtctgaaatcaacttagaaagtttattttgccaaggttaaggatgcattcatgacacagcctcaagaggtcctggccacatgtgcccaaggtggtcaaggtccagcttgcttttatacattttagggagacatatcaatcagtacatctaagatgtacatttgattggttcgatctggaaaggcaggacaactcaaagcaaggcttccaggtcataggtagatttaaagattttctgattggtaattggttgaaatcaatggaaaggaatgtctgggatgtcctaaggggttgtggagaccaaaattttatcatgcagatcaagcttgtccaacccacagcccactggccgcgtgcagcccatgatggctttgaatgcagtccaacacaaattcgtaaactttcttaaaacatgaggggtttttgttttgtttgttttctttctgtttttttgtttgtttgtttttagctcatcagatattgttagtgtattttgtgtgtggcccaagacagttgttcttccagtgtggcccacggaagccaaaaagagtggacacccttgatgcagatgaggcctgcagatagcaggcttcagagagaatagattgtaactgtttcttgtgaaacttaacgtctgtgttgttgttaatggtggttagctttttctgaattccagaagagaggagggtataatgaggcatatccaaacctcacttcgcatcatggcctgaagtagtttttcaggttagctttggaatgcccttggtcaggagaaggggtccattctgatggttgggggacttagaattttatttttggtttacgtaactatctactttttccccaaaaaaaatcatgttgaaaactcaagaccttaagtttacagctcaagctgatcctgaaagttatctcagtgagattgtaatgttgctcagtctttcagaagttgtataaatgtaccttttagcctagtaaatgcaattctaggactctagattaagaaaactatccaaaatatgggaagacatttacttacatatttgtacagatatctatatttggatttatgtcagacttaaagatatagtaaaccattttggtcgtgaaaatgaatgtgaaaggttgaaagcaaccaaaattataaatgcattatatatatattagattaaatgtccatttatacatttacatgtggggtaattaattgttaatatactaatataaaacattttaatatactagtaaattaatatattgtatgttaatgttacataacaatttatgaaaaaattattaaaaggagattgccaataataatagagcaaaatctgtgaaaactaaaatcctgtttaataactttatttccaagcccctgtccatttatcagtcagttatttgttggtcttccaaatgccaacatgcctgtaacttcagggtctccttcttttagcagtaaaggattttttttctccctgaggaaatcactagctgtaccctataacattttctattcttgtctcaaggcccaaaattactagaattataatattctgcacaagatattgtaaatactacaaatgccatcagatcttttgttaaactctgtaaacccagttgctaccctttggctgcatagaatctataaattctaacaaatggatgagaaccaagttaagaattctagagtgggataaggggatgtgatgtattctattcagggatgaagttttagagactccaagtatgaaacagaaaattgaggatggggagacctgatgggtaccacattaagtttaaaaaaaaaaaaagtgttttctcagctgtctccccttttgaccccatactataagatctaactggaaagagcaagaagctgtctcagttaagaaagttctatacaagaacccctgtggtagaacaagtctacaacaagataacatgattgccccaaggcagaagtaaaagaaatattgtaggaaccataaatgaatttaaaagctgatcttttaaaaaatatataacttatcaaagtgagagatcagtcctttatgatatttaaggagttcctgtgaatgcaccattatgctggatactctgaaaaaatgcaaatcaagtatgaagcgatataaattctgcccttaaggaacttgcaatctagttggagatttatgtttaacacaaagaagcagtttttacaaatacttcttttgaggattctgggaagatggcagagtagaaagcaccaggaatctgtctcctcacctagacaagaattgtactggcagaatctgatgtaactattttggaactctggagtctattgcaggcttgcaacttccaggggacagacttagatggtaaattgcagttaattttggtctatttgagctcttagtacagtagcagctacccatcttccacctctcaacccttagcagacagctgtgcacgttattagagcaatctgcacacaacttacaggaatcaggtgggcaaaaagaaacacaccatccagatatctgggatctgtgctcttgattggtcattgctccttctcgtcacaaaagcgcaaagagatgggcggttgttgttgttacaccttactcattgttacaaccccctccccactcactcccctgccccatggatttaaagggctagaaatctccctctgcttcatttttctctttcacttttgggagccggatattaaagactaggacatttaaaaacaactgcatttatggggaaaattagaaagtcactgtacatacctagggaaaggctcaggagagaccttaagtttatagctcaagctgatccttggcacaggattaacaacaattacacagcaattaaacaaagcaaacacacacacacacaatgtagtctgggagagtgatgttagcaagatggccaactagaagccccttctgctcatcccctcataagacagccagaacaacaaataaacaactacattttagcaaacttaactaagagtgctagagtgcatcaaagaagtaacagaaatcctagtgagcagagaaaagtgggatggccacatggagaatgggaggaaatgccaggattcctaggatcatctgggaacgaggaggaacttcttcctatggcaaggagataaacaagaagatcccagctacaccatgggcaccaacagatctcaccactggggttccttagagtccagacagcaactaagccaagctgaggaagctgcctagagtctgcacagctgtgttccctccagagaaggagccaacactgtgctccacctgctgtggcccacacagctactgtgccactccaccttggaactggaactacttctggagtgtgtcttgcttcggggacttgtagccatggcttcctttcatctgaaccacgccaggctggtggctcaacatccctaagctaaactttaagcagctgttacacccttccctgtggagtcaagcagaggtggaactactccacctactcctaccccactgcccttgggctagagctgaagcagtatcctatttcctgggaacacactaccttggccacccagagcagtcatgcacccctgtgcctaagctgaagtggtatacggcattccagggaaacagggcctgaaccacccagagcagtcacactccccgggcctcagctgaaggagcacatcactccctgcagaatcagtgccctggccaaaccgagcagctatgcatcccagggctgagctgatgtagtatcctatgtctcagggaaacagagcagtggctgagctgagacaccctgttctacaggccaaataactgtagtaccccgcttccctggagctggactagtcctctagagcctgagctgctgagacactctgaggagtggagtcatcactgtgctgttccctaccccccattcccagcccagacaacagctatgcttcaccattttgtagtacttgctgctgctgctacacttggcctcacagtctggggtactgcttatccctagctattccaagatttagagtcatgacttcatggtgcctcatcccttgggacctgtgttgccactgagccctattagctcatattcccaaattaaaaccataccctgctccccaggcccaaacctccagagaaccccttctttatagtcaggccagtgctatgccctgacccccataggggtagaatcaaagctacaacccattctctgggcctaagctgccaggaagcacctccaggtcacaaatcctggctctgtgagcaactacgtccaagccctgccacagagagcaaacccacctcagcaaccaagtgtctcagtaggtttgtgagatcctgagcctaggacctttgcccagtagccactctgaataccttcatctggaatcaagagctgctgcagctgcatatatatagcccctgtcagacctgacaccaagaggtgttgccttggctgagtctccccattgtggggaagacaagaataggaggatcctaaaagccttcaacactgagaacattaacaacctacactaccactgccacaaacttctgcagcctaggcccctgaggcacccatttactactgacattgaacacaggtaaagcagctgctttaccataccactgcatctgtcaggaaacagtcaccacacccttcgaaaccagcatactgaaacccaactgctaataaaagactttatctttgaaagccactgtctgtaaagtttggaagaggtaattatcctatcaacacaaagacacaaaaacatgaaaaagcaaggaaatatgacaccaccaaaggaaagtaagaactctctaatggtggcccaatgaaaagaagatcaacaaattgctggaaaaggaattcaaactaatgatcttaaggaaactcaacaagatacaagaaaatacagatagttcaatgaatcaggaaaacaattcacaatacaaaaaattcaacaaaaaaattaaaacatgatgaaaaacaaccaaacaaatcctacagttgaagaattcaatgaattacatttaaaaaatacaataaagagcttcaataacagacttggtaaagcagaagaaagaatctctgaacttgaagatataccatttgatattacttaattgtagaaaaaacaagtgaaaccctacaagacttatgggacatcattaaaggaacaaacgttcatactatgtaagttacagaaagaggagaaaaggtaagaggcatatacaaactatttaatgaaataatagctgaaaacttcccaagtctggagagagatacagacatccagatccagaaagctcaatgattcccaaatagatttaacccaaaaaggttctctccaaagcacattattatctgttgtcaaaagtcaaagacagagaaagaattctaaaaatagcaagagaaaggcatcaagtcacatttaagaaaatccccattcagctaacagcagatttcttcacagaaaccttacagtgcagaagaggatgggatgatatactcaaacagccaagaatgctatgcccagcaaaactatccttcaggaatgagggagaaatacagtttttcccagacaagcaaaaactgagggaattcatcactgctagaccagccttatgagaaatgctccagggagtcctacatctggaagtgaaaagagagcagtcagtatcttgaaaacatggaaaagtataaaactctctgatagagcagatacacaaaggagaaagagaaaagaattaaaccttatcaaaccatcaaaccacaatgataaataataagagaggaagaaaggggcaaaggatattattagaaaactttaacaaaatgacaaatgtaagggctcaaatatcaataataatcttaaatgtaaatggattaaattccatacttaaagagactggcggaatatttttttttttctttttttttttttttgagacggagtctcgctctgttgcccaggctggagtgcagtggcgcgatctcggctcactgcaagctccgcctcccgggttcacgccattctcctgcctcagcctcctgagtagctgggactacaggcgcccgctaccacgcccggctaattttttgtatttttagtagagacggggtttcaccgtgttagccaggatggtctcgatctcctgacctcgtgatccacccgcctcggcctcccaaagtgcggaatattttttaaatgactcaattatatgctttctataagaaacccacttcacctataaagacacatataaactgaaattgaagggatggaaaaagttattccaagcaaatggaaaccaaaagctgtcaggaattgctatacttatgtcagattaaacagacattaagtcaaaaactgtaaaaacagacaaagaaggttattatataatgataaagggaccaattcagcaagaggatataacaattctaaacatacatgtacccaacaccagagcacccagatatataaagtaaatattactatacgtaaagggaaagatagactccaatatgatagtagttggggacttcagcaccccactctcagcttcggacagatcagcaaactccaagtacagtgaactcaaagagaccacaccaagaaacagtcaaacttttgaaagccaaagacagagaagtgacttgtcatacacaagggatctttgataacatgatcagcagatttctcacctgatactttggagaccagtgtattcaaagtgctaaaaaaaacaaaaccaaaaaactcaaaaccctgtatatggcaaaattgcccttcaaaagcataaggaaattaagatgttcttagatagacaaaagctaagggagttcattaccgctagaactgccctgcgagaaatgcttaaggaagtcctgaaaggtgaaatgaaagggcactagacagaggggacagtgcagattcaggcaggtgcaatggcttctggggaagacccagccagtggggctattgccagcatccagtcagctgccaccttccctgaccccagtgtcaagtgatgcgcagggtgatccaggtgtgtgaggggcagctggatgtccagactgagggcactggtgccatcagtggctatcctaccactcaattcatgacccaggtggtgatccagggtgatatcaccagttatgatgcagttaacacagaggggaaagctgctgagatacactatactttcccacccctgcagtgggagatggggcagggggtaccacatcagggagtacagctgctgttgttactacccagggctcagaggcactgcttgggcaggtgactcttcctggcactggtcaattatttgtgatgatgtcaccacaaggagtactgcagggaggaagccagcacttgattgcccctaggactcaaccttatttatttggacgtaacaccattgtaagtcaagaagcatctctatctatctatgaacatacaatgtgaaatcaaattgaggccataaaacagttgaacctcatcataagagtgactcatcggtgtcacttctaagaccaagaaaaattctatttttatgcagagaccatttgttttttaattaaaagacaactctatttcaaagaggaaaaaaaatcaactcttttttcagctctctcagatgcagaaatgtaattatcagcatccctgtgctgggagcaatcattagtttttttagatttttaaaatatacttcattatgtttcactgtattcattctttaatcagggatgtgagggatagaataacatttagaatatctgtacagtttgtatataatgttcttatttcttgttgcttttataggtggaaaaaatctaaaatctcctcaaaaagtagaggtcgacatcatagatgacaactttatcctgaggtggaacaggagcgatgagtctgtcgggaatgtgactttttcattcgattatcaaaagtatgtgactctacttactgatttgtcagaatgacctgaataatttttacaagtttaacaacaccataatttttagatttggaaagtgtttggtttttctattttttagaaatgttacgcctattttacataatatttttaactttgtttctgtagagacttagtcaaatacatctttgggtgttgaagcaaaaaattggggatgagggtggtagacagcgtctctaacccatagccattccttctttcttctgggtgttccagcttcttttttttttttttttaattattatactttaagttttagggtacatgtgcacaatgtgcaggttagttacgtatgtatacatgtgccatgctggtgcgctgcacccactaactcgtcatctagcattaggtatatctcccaatgctatccctcccccctccccccatcccacaacaggccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagctccagcttctttcaatataagttggggtctgagctagggtatatcttgaagatatggcattgtactccaaaaggtccatcgaagaccttggaataggccaccaggtttcctgtgatcaggctttcctattatctccatgatatactatattttaattttaggtacactttttttttttttttttttttgaggtggagtcttgctgtgttaaccaggctggagtgcagtggcacaatcttggctcactgcaacctccacttcccggtttcaagcgattctcctgccttagcctctcgagtagctgggattgcaagcacatgccaccatgtttgactaatttttttatttttagtagagatggggtttcgccatgttggccaggctgatctcaaacttcttacctcaggtggtctgctcacctcagcctcccaaagtgctaggattacaggcgtgagccactgccctggcctagatacactttgtaaatatattgttaactgggcatggtggcatgtgtctgtaatcccacctacttgggaagctgaggcagaagaatcgcttgaacccaggagacagaggttgctgtgagccaagtttgcaccactgtactccagcctgggagacagcaagactccatctcaaaaataaataaataaataaaataaaataaaaatcgatatattggaccttgcatttctaaagactcagtttttctggagtgttgatgtctcttccttagtactttctacttaattattcaagaggagaggcaggcagaaggaggaatatagaagggaacacagatcaggaagtacagtactttgccttccgattatgtgttggggccccacctgccaaccatgttcccctgtccaagaaaaagcaggcaatgaagaaataaggcattaggccctccggaaccaggagcccaccacttcagccacagctgtgacactattctcgagttgtaactaaaactggcatatgaatctcacagcttcagtaattgtgtatgcatatataaacaaatacacactgtatatatgcatatatacactatatatatacatactgtatatatacattacactatatataatacatactgtatacatacatatacacacattgtgtatacatacatatacacacattgtgtatacatacatatacacactatatatacatatacacactgtatatgtatatgtatatacacacacaaattcatatatgacttttctcagaattgatcatttaaaattttttatctctagagattttcattaaattgaactttgagtttggttaccagttttgttttttcccttagtttggaatttccttatgaacaactattttaggtagagaaggaattatttcagatacccttatttaatgttacttgtataaagaaactatttgcaaaatatgcatccaacaagagcttaatatccaaggaactcaaacaatcaacaacaaaacccaaatccatcaaaaggtaggcaaaagataggaatagatatttttcaaaagaaaacatacagtggccaacaagtatgtgaaaaaatggtcaacatcactctaatcatcagagaaatgcaaacgaaacctgccatgagatattgtctccccgcagtcagaatggctgttattaaaaagttaaaaaaggctgggcatggtggctcacacctgtaatcccagcactttgggaggccaaggcaggtggatcacctgaagtcaggagttcgagaccagcctgaccaacatggtgaaaccccatctctactaaaaatacaaaaacttcagccggatgtggtggtgcgtgctgtaatcccacctacttgggaggctgaggcaggagaatcgcttgaacccaggaggcacaggttgcagtgagctgaaatcgtgcccctgcactccagcctgggtgacagcaagacttcatctcaaaaaaaaaaaaaaacccaacaaatattgaatatatttcatgccaaacactcttctgactgcttagactgcctcagtgaacaggagaggcaaagatggcatgaagttatattatgaaacggatttcatgaagtaaatattacattagttacatattcatatttcatattctgttctgagctaattattgcatatgataatagtttttttgttgttggttttttttttttgagacggagtcttgctctgttgcccaggctggagtgcaatggcgcaatctcggctcaccgcaacctccgcctcccgggttcaagcaattctcctgtctcagcctcccgagtgcctgggattacaggcatgcacccccacgcccggctaattttgtatttttagtagagacaggatttctccatgttgatcgggctgatctcgaactcctgatctcaagtgatccacccccctcggcctcccaaagtgctgggattacaggtgtgagccaccgagcccggccaataatgatttttttaagaaaatataaaagtagcttctgctgcaatatcttgattagatgtaaaacagttttaatggagcatgcttcagcatctcctgaagtaggaaagacagatgtaaacagtgaggttgggttgaaattatattaagttttaaatttttgataaggttttctgtttataatgagagtttctggatttttagaaatagattctgatgtggaaccttttcaagaatgtttaaggtatttttaatgccagctctaatctcaggcctcagatatgtaaaagtggaagtgaaaactggccaagaatgaagtatttcatatgctagtgtatatttttggtaatttcttaaaaatgtttccattttgaaaaacaaggtagacttgtatttggttcagcaacaaaattattttggtattatctctggtttctaatatctaaatcgtctttaaaatggcatctgtgatattattaaaaataaataaatcagctaatgaattaggcttgacaaaaatgccttcccagaagatagtttctctgctacttatggtcaatgggcttaacataggtaaaagttctcaaatctgctaaattggccgggcatggtggctcacgcctgtaatcccagcactttgggaggctgaggtgggcagatcacctgaggtgaggagtttaagatcagtctagccaacatggcaaaaccccatctctactaaaaaaaaaaatacaaaaattagccagacgtggtggcacacgcctgtaatcacagctagttgagaggctgaggcaggagaattgcttgaacctaggaagtggaggttgcagtgggccgagattgcaccactgcactccagcctgggcaacagagtaagactctgtctcaaaaaaaaaaaaaaaaaaaaaaagaaatctgctaagttcgtttctatccctcactttccctgcaagctcttcttcccctttctgggcaacatgtccttttctgctttaggcactccatgcccactttatttttcatgtttgccccttttttgaaaggaagaatctaatatcacttcagctttctgattggccagttccacttccaaaaatttatttgtttatgtaaacattttcagttttgtggtttctgatgatgtaatagaagaaattacggagacaggcaagcagaagggatggtttgcttttggagagggcagaggaaaccttgaaaccatactgattctgaggtctttcttagggaaggtaagtctattcataggaggaggtcagaagggaatcatcaaatccaattccccagtttctatttaattttattttattagagacagggtcttgctcggttgctgaggctggagtgcagtgatatgatcatagcctactgcagcctgcagccttgaacccctatgctcaaatgaccctctcacctcagcctacccagtagctaggactgtgggcatgtgccaccatgccctgctttgcctttttttttttttatttctcatagagacagggtttgctatgttgaccaggctccaaactttcaataaggaagataagatccagaaacacaaaatagtttaccaaaagtcacacagctatttttaacagagccaacatactaaatccacttttaccttatgggtcatttatttctctgcttcctgaagcaaccacccacaaaattatataaagaactgtattttaaaattcagtttcataagtaataacttggcttatatgcattgaaaaagagtggaagggtgtatgctaaaatgttaataggacattagctcaagtagaagaaataactcttaaaccaaaaatagaaataactcttaaacaagagttattaagagttaagaaataactcttataccagtaaatagaaagtatttgacacttacatttatacatttgctcactcattcatttgttttttttactttaaagaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaaggtaagaaaaagttgctagctgaattatattctttagtaaatattaccagagcagttcactttccaagccattcatttgcatgatgcaaaatctaacatcttttaaaaagaacaaaaattcccttaaacctatatcttcttcctgctatggctccatttgtcctactttccctgtagtagtggttctcaaagagtgatcctcaaggccctttcagggggctgtaaagacaaagctatatttatgacaaatctaagacttagttgcctttttaatttttgttctttcttgtattcacagtggagttttccagaggaggctgtttgatgtgtgatgtggtgatatggtcactgatttaacatagaattcaatgtgaaattcatctgccttctttattaatccaaacattcaaaagatttggaaaaaaaatgtaaaacagcaccactctgaagtttctatgttccttttggcaaatgtttgttaccataaaataggtttatcattgttatttctttctttttttttttgagacagagttttgttcttgttgcccaggctggagtgcaatggcacaatcacggctcactacagcctctgcctcctgggttcaagtgactctcccgcctcagcctcccgagtacctgggattaccagcatgcatcaccatgcctggccaattttgtatttttagtagagacagggtttctccatgttggtcaggctgacctcaaactcccaacctcaggtgatctgcccacctcaacctcccaaagtgctgggattacaggcgtgagccaccatgcccagtccattgttatttcttaatggattaattagttaaaatggattgaaaactttaccagttttaatgtttaatatgctaatataaaaatatacagcccacataaataatggctgtttgggattctcgataattcctttaagaatgtaaaggagctgagtgtagtggcccacacctgtaattccaacactttgggaggctgaggtgggaggatcacttgaggccagaagttcaagaccaacctaggcaacatagtgagaccccatctctacaaaaaatatataaaaattagccaggcatggtggtgcacacctgtagtcccagctattcaggaagctgaagagggaggatcacttgagcctgggagatcaaggttgcagtgagctgtgtttgtgccactgcactccagcctgagcaacagagctagaccatatctcaaaaaaaagtggggatcctgagaccaaaaggtttgagaaccactgccctgtaccaagaatgatctgtactccctttctatactaatcttccaattccctgtcagccctctccattcaaattctgttcctcctcacttaaaaccactctttttggccaggcgcggtggctcacgcctgtaatcccagcactttgggaggccaaggcgggcagatcacgaggtcaggagatcgagaccatcctggctaacacggtgaaaccctgtctctactaaaaatacaaaaaaaaaaaaaaaaaaactagccgggcatggtggcgggagcctgtagtcccagctactcgggaggctgaggcaggagaatgacatgaacccgggaggcggagcttgcagtgagccgagatcgtgccactgcactccagcctgggcgacagagcgagactccgtctcaaaaaaaaaaaataaataaaccactcttctcaaggtcacagcagcctccacaatgccaagcaaattcccagtcctcttctggcttcatccctctgtagcatagatgtggtcatcactcagtttttcctttactggatctctgggacactgctctttcctggttctcctcctgctcattgatcgcttcatcttcccaacttttcagtgttagactgctgctgggctcagtcattgaacctcttctctttctgtatcactccactggtgatcttacagctttctatcctatctgtatgctcttaactcccagaagtggcaggcacatattaagtgctcagaattatttgttgaatgaaggttttggcattgtattaataaagttccatagtaattgttttgatttttttgcagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagtaagcattatttttacctctgtttaatcgatgtgagagaaaaattaggcgaattaatcctaaaatttgactttatacttttttaaagaaccaacttatatttgtgttataggaaaggattgaaaatatttattccagacataaaatttataaactctcaccagagactacttattgtctaaaagttaaagcagcactacttacgtcatggaaaattggtgtctatagtccagtacattgtataaagaccacaggtaaggaagatgttttgttttagattcaataaatatataaacagattgtcaattttggcatcttccccatattgctgaagtttacatgataggtcaatatatgttaaaaacattgtaacatttacataagcaaaataaatgttacttgggatttttgtctcaaatagtaatgaaaattaattctacttaaaagttcaggctgggcgtagtggcccacgcctgtaatcccagcactttgagaggctgaggtagctggatcacttgaagccagaagttcgagaacagcctcgccaacatgggaaaaccccgtgtctactaaaaataattagctgggcgtggtggctcacgcctgtagtggtagctacttgggaggctgaggcacaagaatcccttgaacctgggaggtggaagttgcagtgagccaagatcgcgccactgcactccagtcgggagcaagggggacaaagagtaaggctccgtcttagaaaaaaaaaaaagttcaaatattttgtaatgacaaaacttttcatttgttcagaatccacatgaagcaggaggtagctgaactatgagttctgcaagtgggaagaaaaggtggggaagtagttgctagtagacaagttattgttcaagaaagcatacctttgtaagtggaatgttaaaatatgaaagtatcctgatacatttagtaacatctttccaataattaaggtcaagggcaggagctgggatttgtttattttaattgtaaatttcatatgcttttttttttaatcaaacattacggaagggtttaaagtgaagtcttcttctcccttcttatccccaattccattcactagagataagcattgcttagcagtttgtgtatatcctttcacaacttttttcaggatttatgtaagcatatacacagacccacagtttcttgggttttgttttttaaaattacaaaataaaatcttactagaagtattttacagcttgcttacttaacccagtgtgttggggatattctatatcactcaatacagatctattacgttcttcatttgatcttagccatctattgcattctttcttttttacttatttatttatttatttatttatttatttatttatttttgagacagagtctcactctcttgcccagaatggagtgcagtggctcaatctcggctcaccgcaacctctgcctcccagcttcaagcgattctcctgcctcagcctcccgagtagctgggattacaggcgtgtgccatcatgcctggctaatttttgtatttttagtagaaatggggtttcaccatgttggccaggcgcgtctcgaactcctgacctcaggtgatccatccacctcagcctcccaaagttctgggattacaggtgtgagccactgcgcccggcctgtagtctttcaaatggctgcatagtattacatagtgtgaatacaaaccatatttaactattaccttataatgataaaatgcgagcctttatcttcttgccagttatctcacttgagtaaaaatgtgtgcttttttttatctgttctttggcttctagttgaaaatgaactacctccaccagaaaatatagaagtcagtgtccaaaatcagaactatgttcttaaatgggattatacatatgcaaacatgacctttcaagttcagtggctccagtaagttccattccataaatttccttttgcccagtttgttttgattatgcttcttttcgctctgcatcagtcaccaggtccttgcacacagaatgaccgactgggaggtgggtacgatatattggaaacgtgagaaatctcatttctaaccccagttctgccagtaactaactggatgacattgagctaatcgcttaacctccatgggcctcaatttcttcacttgtaaaatagatggattctaatatctggggttcttactggcttaagaaaaaaaagaaagtgtaactagttgcatgtgttatttccccaatctggaagactcgacagttgaccctgatctttttctaagaactcacttcttccatgagtccttaaaatgatctcagtccactcacttgttcaattcaaaaaattagccttcctattttctttattactttagtggttttgacaaaattttgtagtagatacttcggtgggaaagaaagttggaaagaactatgttctatgtggttgagcagaggctagctaaacatggatgaagtccaggcgctgcataaatgaaagagaactggcctggtgcagtggcgcatgcctatcgtcccagctactcagtgggctgaggcaggaggattacttgaggccaggaattgaggctgcagtgttgtatgatcacacctgctagtagccgctgcactgcagcctgggcaacatagtgagacccccatctctaagcattaaaatttttaaaaagctgataaaagagaactgcatgtagtttatattgattggaaaattgtaggagatgaatagagaaaagagaagaggaaaattaagtagaaggaaaaatgggttatggggagaaaagagatggaaagaaagatatacattggtggcagaggagtagagagagcaaaggcaagtatagctaagacaggaaaggaaaagtcagaagaaactggaaagaaacagaaaaaatgagggagaagggaagtgtaagtaccgctatgatcaatttctatcttttagtgttaattttgaaccaagggtgactggtagaatgcaaatgcatttatgtgcatatgtgccccacaatgcatatataacctcacaaaccaatcaggaaactgttcagtagtcttttgtgtatacctcactttcagaagtgaataaataatagggtcaccaaatagataatgagaggtatttctgatagctgatctctaagcttcttttgggtacttaccatattgtacaaagcactgaagaaatggaaagagtcagcagaatcaaacgtggttcaaaaattgaaagcagttagccaacattgcaaagtgttgtgtggtttaggactaaagagtggtatacaaattataagggttgcagaaattgaaaatgtaaaggtgaataggggctaaagagaccaaagaagccataaggaaagagataaggtatgaacaaggccttgattgttaattcagattttttttaagtagacaactattagatgttagttttctgtgtctgtaactaattaccacagacttagcaacttaaacagctgtttattgtctcaaagtttctgtgagtcaggagtccaagcgtggcttagctggctcttctgctaagcagtcaaggagtcagtcattcatacaagacttgggggccgctcccaagctcacatgttgttggcagaatttatttctagagctcatggtggctcacttcttagaggccatcaggaagggagagtctgacctctagatccttttttttttttttttgagacggagtctcactctgtcacccagactggagtgcagtgacatgatctcagctcactgcaacctccgcgtcctgggttcaagtgattcttctgcctcagcctcccaagtagctgggactacaggtgtgcaccaccacacccagctaatttttgtagttttagtagaaacggggtttcaccgtattggccaggctggtctcgaactcctgacttcaggtgatccacccgcctcagcctcccaaagttctgggattataggcgtgaggcaccgcgctcagccattttttttgtatttttagtagagacggagtttctccatgtttgccaggctgttcgcaaactcctggccccaagtgatctgcccacctcagcctcccaaagtgctgggattagaggcatgagccaccatgcctggcctagatcctcttttaaggggttcatctgattaggtcaggcccacccagaatagtctctcatttgattcaactgatttgggaccttaattacatctgtgaaataccttctcttctgccacttaatgtaacctaattatgagaggagggcctccatcgtatttacaggtcctgcccatgctcaagaggaggggattatacaggatgtgtacaccagggggcaggaatcttgggggccatctcagaattttgccttctccagtggggaggatgtccttctagagtagcagaacatttggacaccaggtggcaatgggaagaaagctgaataagtagaatgggacaagattagggtcaacctcaggctgtcctgtaggcttttggggattttgtgttggggtgatagttaacctgagctctggatttgaggaaggtgcatgcggcgacatggtatgtgggagagtggactaaggagacactaaagagagataaggaaaccagtcaggaggctattagagttctgggcttgaactgagatgcttttagctgttggtttctgggcaagttacttaacctctttagtctcgtacttatacttgctcttataaccccgcagtgtgtctctattttagcacttaatcagtgtccattggtatgctggcgcatgtttagcagctggctttccagaaagaaaaagtcctattttgtagtgtttgctgatttttatgatataaatattcccaccatggccactttcaagccaccagcctgatgtccctgaatatggagttgggaacatatgcacagtagcacaccactatcatatagctacaatagataaagatagccccaagagcttagaaaataaaatgtagtaaaataattaggacaagatgaatttatttattacctctgtctttaaaacaattttttatttgcaaatttatataacttaatttttagtaatggtttttctttaaaaaccagtttgtattttaggaggccgaggtaggtggatcacctgaggtcaggagttcaagaccagcctggccaacatgacgaaaccccatctctactaaaaatacaaaaattaggcaggcctggtggcgtgcacctgtaatcccagctactcagggggacagaggcaggagaattgcttgaacccaggaggcagaggttgcagtgagccaagatcctaccactccactccagcctgggtgacagagcgagactcggtctcaaaaaaaaagccaaaaaaaataaaccagcttgcagcattcctggaaattctaactaacagatgttcttgcatattgatatgagccacctccagcagagcacaacatgaccacagtctggaacagtctttggttttcttttatgttagatgcatatctcttccattgtttgtgagtttcctgagtgtggatactatttatttctgtaaccttagcccctaacatagtgtctggcaattgtaaatacttaataaatatctaatgaatttaaaaaatatttgtcttaaaagcgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaaggtaaggcagtagtttttactggagattgtaattctctggtgcaagtttttaaaattgtttttctaattgaacattatttctttacaaattttttctagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgaggtaaaaagactgtatagtataattttgtaacttagagttataattatgatttgggtaaataaagcttgaatgtaaaatttgggggaaatttttaaactttatgtgggctggatgcagtggcctgtaatcccagcacttcaggaggccaaggcgagaggatcacttgagcctaagggtttgagaccagcctgggcaacatagggagaccctgtctcaataaaaattttaaaaaattagcctggtgtggtggcgtgcacctatattcccagctacttggggtgggagggtcacttgaacctgggaggtcaaggctgcagtgagccatgatcgtgccactgcactccagcctgggtgacagagtgactgacagcttgtctttaaaaaaaaaaaatgtgattaactcagatattaacaaaatgaagattatgagcatttttcatgttttgcactgtagagttatgggtgagctgcatctgggccccagtttgcttttaaaatacagattcctgagcctattgttactgaatcattatctctggggatggaactcaggaatttgcatttttaacatgattcccatgtattcatctaaacctgggattctcagcactattgacgtttgggctggatagttccttgggagggggctgtccagtgcagtgcaggatgcttggcaacattctggtttctgcctactagatgccagtagtgttccttcctagttgtgacaaccaaaaacatcttcagatattgtcaaatgtcccctggtggctcctccaaggggacaaaaattggttcttatgggacaaaagaatttatgtagtacagttgtttgttttcctccaaaaccattggaaagcattcttccaaagttcagctttgcccaacaaaatcttattccttagtatttaattttatgatgggggaaggattaggaaaaaattgcccaaaaagttgtttagttggggaggtaatgaaaaaagggttgacaaacactggtctaaaccctaaaattcagataccactgacaaagataatatataccgtcagataatatacgtgtttcccagatcacttccccctcgtggacttgtagtcaagaatcgacctttaaaactcctgtccagtcaggctggtaaattctttaacttcacctcattttctattggaaatctaagcaaattccattgatttggctgcttccctttttaattgtctgacaaccctgtaaccatagcttaatgtagcccattgagaattatggtcggttttcagatgtctgtagatcagacaaacctaaatttctatctcactgctaaactgtgtaaccttacgtacgcagggtgctttacctcttggagactttgcttcctcttctctgaagtggtggtaatcataacaactaaatttttcaaaaggatgtttataaggtttaaaaggaagtaacaaatatgaaaatacctagcacattgctggacaagtagtagagattcaataaattgtagttgccatcttaacctatactggataatatatcaataattgttactatagaaactcttattgaatacttatatgtaaggtactatgctaagtattgtacatgaattgtctcagtcattcttcaaaacaaccctgccggattatgtgattggttacattgctgtttggcaaatacttgggacggtgacttcttccctgcaccaccagaccgtagatgctggagcccaagtagatgtgctgagaacagaggccttaagtgtgcttgcagggtttggcttggctcttgcactgctcctatttgccaggaataaaatgtattccacatagtctctggtccaaggaggattagaggctgctggagctgacctaaaccccatgcacagcctccgtgggagctgcccagccagtctgtagacttgtgagtgagaaactacataatcgttttgtgagccactgaacgttaaggcagttttgttatctatatttttttattttattttattttattttttttttttttgagacaggttctcattctttttcccaggctggagtgcactcatgtgatgtcagctcactgcagcctcgacttcctgggcttaagtgatcctcccacctcagcttcccaagtagctgggactacaggcacatgccaccatgcctagctaattttttgtatttttgctaaagatggagtttcaccacgttgcccaggcttttttggtggtggtggtggtggttgttttggaaatagggatttcctcagcctcccaagtaacagagactacaggctcacaccaccatgcctggccaatttttttgaaatttcttgtacagacagagtctagctatgttgcccaggctcgtcttgaactcctgggctccagtgatcctcctgcttggcctcccaaagtgctgggattacaggtgtgacccaccggcttgttagacattattctggcgatagctgactgatacagatagcagcaataactgtcccgattttatagatcagggaatcaggtagagagaaattaaataatgcttgcaagaccacacagctgtaagtgatactcttaataaggcagtttgaggccaaaacccctactcttaaccattctgtcactaatcagaggtaatacaatggcaattaccccagacttggcatgtacttgtaaatcaattagaattctcttaggaatagatcatatgcttttttggcagcagcatttttaactttctgatttggttatagtggtgtatctaaaacaaatttatatttctcacacatatactctgtaatcccagcactttgggaggccaaggtgggtggatcacttgaggccaggagttcaagaccagcctgaacaacatggtgaaaccccatctctaccaaaaagaaaaaaaaattaggcgtggtggcatctgcatctgtaatcccaactactcaggagggtgaggcaggagaatcgcttgaacccaggaggcagagattgcagtgagcccagattgcaccactgcactctagcctgggtgacagagcgagactgtctcacaaaaaaaacaaaacaaaacaaaacaaaacaaaaaatacataccaactacgtgggagaggccaatgttagactgaacataaaaaattgagaaagcacatattccctgatttcttgaggtgactaaattttatcagtgatttaattatattttctagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggtcagaatcttttattgtcttttttaaaaatgtagctagacataataaaagtaattctatactgtacattgaaaattgtaaaacattttctctttactgcaaaaaatatatagaaagaatgttttcttcatgaactacatgaatcaaaagtagactttttagaaaatatttgtaacgcttaactctcaagtcggtgttgttggatgctttatatttcatccagtatccctataattaatttccttaatgtatttctctttaacatttaataaaactattttaaatttttagaatataatccttaacataattatcatgtagaaatcacttagttcaattgtgagttttttaatgtgggaattggtttagtctcattttctattttacagtttctagtgttgaccggtagaggcttagtcacagaatatctattaaattttgctagttgtatggtgtaaaagtgctgaaggatacttgcatgtttggcctgtatgtcaatattgtatttctccctgaggatctcttacttcagttcccacgccaatctttaaatgtaaatgtcattgcctatggttgctgtggactcagtgctgccagaaatatttttaagagtattatttaatagattttatatttcctttcatatggctagtctttcacacagctgtcagcactgttaaggcatttgtatgtcaaaatatatgctaaatatcacgtatatctttttaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgaggtatgttactttttttatttttttgtcaacagctaggtaatgaacagaaaatgtgtttgatttcaacaggatatatgtaggttttcttgatatccagaaaataatagagactgatttgggtatcttcttcaaagctttagtcaattaactttaaaaacagtaatttcatgtaataacatagcatgagatagtaatgattgtccttaatttcatatttttctggcaattcctagattcactgtggcatttgttttaccgtttaaagcctgtgattcttggccaagcgtggtggctcacgcctgtaatcccagcactttgggaggctgaggcgggtgggtcacttgaggtcaggagttcgagaccagcctggtcaacatggagaaaccctgtctctactaaaaatataaaattagccgggcgtggtggcacatgcctgtaatcccagctactcgggaggctgaggcagggggatcgcttgaacctgggaggtggaggttgcagtgagccgaggtcatgccactgcactccagcctgggtgacagagcaagactctgtctctaaataagtaaataaagtctgtaatgtgattcttctcagtacagacagtcccaaacttacgctgtttcaatttgtgatgcgtttgtcagaacgtaattccattgtaagttaggagcatctgtatatatccagaagactaaaatattctatcagcgtagaaagtatattctatggatgaaatcatacaaaatgaaataactaaaaacatgagactttttttatgacacacatcacagttttttgtttggcacttctatgaagctagcatattaaatgaaagcactgaatggtgaaggcctaaacatagaatctgttcctgggaaaccatgtgctcatctagggtgggttttgtgaatttgagcaagtcactaagggcaggtaagcaagtacccttggctgtaaaccaccccatagaggtgttaggagcaaaggagttaaaccataagaaccttaccactctaaaaatgctccgtaaatattaacaattttactattatacccctgagtttttaaatgtcattcctgtgtactgtaatattcatagctattatttaaaatagacttaaaaactagttacaatagccaataatttctcaattgtgcttcttctggatatatatgtgttggatacaaacatttttattatttcaaaaaaaaaaagtcatgatcccagagtccgcccgctcctgtcctttcccgtgttcttccccgcctaccccgatggcacagtgtacctttcttaggtactcttcaaagactcaccacagaaggtactaagatatgagtgacctcactaatgatgcttttaaacattataaggcaattagtatgttcttaggcgactttttaatatgcatgccagaagataggttttctcagtaatggatgtaagaaactaaagctattacaactagaaaaggaatttttattattttaaataattgatttctactctttccctttttttaaattagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagacctctgattcaaaacttattagaacagtagcttctgctggaatttgcaatcactgaagtcatagaaaataggtaactatctaattagagaaataattgttgtattttaagatctgagagtgtgtacaagttttagtatacatgccatgccagaagatagtgtatgcaagaagtcttgggaccagaaaatggcaatgataggagactgacatagaagaagaatgcttccctaggaaaaaggtcgctggctttggtgcaagaggaagaagaatgttccactggaagcctgagcacctaatcagctctcagtgatcaacccactcttgttatgggtggtctctgtcactttgaatgccaggctggcttctcgtctagcagtattcagataccccttctgctcagcctgcttggcgttaaaatacaaatcattgaactgagggggaaaaatgtaactaggaagaaaaacccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcaccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttctgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattgtgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtattgcatagccttgctttcttgaactaaactgtttgcccttcacaagtagttcttctttcaggattagttcgttccaaggaggctcttcagtctcacagataagtagatctctcctgctgtctggacacatttcactcggaaattgaatacaatttgtattcaggctgggaacctgaacacacacttgtgtttttaagcttcccttttttacagtggacaaggacacaaataataaataaatcatccctaatgcccaagaa

SEQ ID NO: 1760 - DNA, 32832 bp, Homo sapiens
  source 1..32832: mol_type = genomic DNA
gcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagctgggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagacgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctgagattacaggcgtgtgctactacgcctggctaattgtatttttagtagagatgggatttccactatgttacccagcctggtctggaacttctgacctcaaatgatccacctgctttggactcccaaagtgctagtattacaggctcaatcatcatgttttatcaaagctaaaacccaaactaaaatgccattgcttataagatgcactttcattttatgtaatgaagtaagaaaaaacactgtcaatcatgctatgccatgccaccagaatgaaagcattctgatttcagaaattctcaaatgttaaaagaaaatgggcattttataatttgtgaaatattagtgagttagagcagagcttgacggcactggccctgagggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaattttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggccctttatgctgggtgaaggtgagtgagatgggggaaggttcactgggcaccaaccttctgggctagagaaattgcccaggctttacagaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatacggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaaacagaaggaaagacacagccatactttaccaggagactatgaggcagcgagttcctggagggttgtttgtctgtctaggaggagttggaattcaaagaatcacttcactcaatccatccattttatctgggccttgaaaattggcagggtttgtctggtctcagggtgaatagcaggtagagctcttctttcagaatggagaaggccacagtgtcacagggtgaacctgtgacaaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatgttgccatggcatttgtaaactgtggtggcactggtgggagtttcctttagcatgctaatatattgtaattagcatatgataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatttaacctaaggagcttggtgcattgtcaggcaacagtgagctacagactgagctcactacataattcacagggcccacccagagccaaataaaaatgcctgagaaagtaccactaaaggtactaaaatataaagccttttcttccacagtctctctctctcaacacgtaatgtttttttgtttgctatttaatatcattctaagtaaaaaaataggccgggcatggtggctaacgcctgtaatcccagcactttgggaggccaagtcaggtggatcatgaggtcaggagatcgagaccatcctggctaacactgtgaaaccccgtctctactaaaaatacaaaaaattagctgggtgtggtggcgggcgcctgtagtcccagctactctggaggctcaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttgccctggctgggcatggtggctcacatccataatccaagccctttgtggggctgaggccggaggatcacttgagcccaagagttcaagaccagcctggacaacatagcaaagccccatctctaaaaaaaaaaatacaaaaattagccaggtgtagtggcaaatgcctgtagtcccagctacttgggaggctgaggtgggagaatcgcttgagcccaggaggcagaggttgcagtgagccgagatcacaccactgcactccagcctgggtgacagagtgagaccctgtctcaaaaaataaagaagttgcccttctacaatctggatgtggtggtatctaggggaatgttcacaactaggcaacgcctctgctgtggattgattatgggagatgacatcacacatcaagatatctcagcagatgtttctcaatgggtacagtattatgggattagttccaggcagtcgtgcttggatatctcatgggtggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagcttaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgattatgactcaaaatttagaagctaagaaagaaaatacctttaaatctgaaaacataaaactcaaaaacttctgggtgtttttttgggggggttgttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccattctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctggagtctcccttctgggccccagagtggtcacaggcctcaatgttgtgagctgcagattctatactctcccttctggtttgcctacagccctctcacacatttgtaaatatagtcctgcaacccctaatgatgtcttgggcaaagatggaccttttatatgacgatagccccataagattataccatatttctactgtaccttttctgtgtctaaatatgttcagatacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgccttagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgagctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcagtgatctttaaaaatttaaccgtataaggcagaatttggcaagtctggctttaatgtctcatttatcactgccacttcccacctacatgacattgtataattcaactcagtttcacagtctgtaaaatgaatcttttcatagtgcctacttcagcattgttgtggggcttaaatgcttagaaagggccagtctgggctcatgttatactcccctgctctctgtgatccagggaataagtgagctggggaatccagaggaaggaaaatttgcagcgggctgagctacttaaggaggacttcatggaggagctgggagcagagttgagagaacggcttggggagggagaatgggtaggggagagtgaaaggaagtgcatcatgtgggctgggatggcctgggttattttggtccagtgaaccatggagggacagtccaagggcatcggagaagcccttctgtccagactctccttacacagtgcacagtccctgtttcccatgcttgcctgccctgacaatatgttgctcgttaattgacttactaatttatttcccatgtcctgtagacttcctgttttcaagacaccagggctctctggagaggttatctgccagaggtgtgggttctagatcccaagaaatgactgaacagtggccagaatacaactgtgggttccaaatttcaatgccctttttcttcttctctttagattacacagatgaatcttgcactttcaagatatcattgcgaaatttccggtccatcttatcatgggaattaaaaaaccactccattgtaccaactcactatacattgctgtatacaatcatgaggttggtttgatatttcattttctcttggtaaacatattattgttctgttatatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttatctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcagggaaggcattcataattgtcccatagaggaagggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagccaggatggtctcaatctcctgacctcgtgatccgcccgccttggcctcccaaagtgctgggattacagacgtgagccactgcacccggctcctccggcaagttttactgagcacctactacatgccagggggtccaactgtgaaccaaagtccctgccctcctggagcagacattatgtaaatggagacatcagtaaacaaaggtataatgtgacaggtgtgggtaaatgctacaatcaagaaaagagagggattgaaagtgcaggggtggggagggcataagatgttccattttcaataagatggttggggaagatcacttaatacaatgatatttgggcagagccctaaaggaaacaatgaagtaaggcgcccaaaaatagactctcattacatcaatgctaacaatttcctttttccatttttttctttccaaagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacagtgagttttatctctgtttctccacttcgtccccatcatcaagatctttattatttgctattccatgaaataggaggtctacaaaggtgttttagacctggggctgggctcacctcttggccctgccacttcctagctctgtaaccgtggactgctttgcttctctgagccttggttttctaaatctgaaaagtggaatgataatttgtactttgcagatttgccccgtgcctgtataaggcagtaggaactgctgttttcggttttgcagcctgacaggaagtctggagccaggttcaggtgggctggatctagcgctctcatctctctggcccaggattttctttctttctttctttctttctttttttttttttttgagatggagtttcactctgtcacctaggctagagtgcagtggtgcgatcttcgctcactgcaacctccaccttccaggttcaagcgattctcccacctcagcctccagagtagctgggattacaagcacacaccaccatacctggctcattttttgtacttttagtagaaatgtttcaccatgttggccaggctagtctcgaactcctgacctcaagtgatccacccgcctcagcctgccaaggtgctgaggttacaagcatgagccaccacacctggccccagtgttttcttaatacagcaactccaccccctcattataacccaatgttcttttgtgtgtgaacaccaagtgtgcatgcacctagtacccaaagctcagaggagaagactagaccccaagaacaggcctaccccttctttctttccctgtgactcaagtcagttccctaacacactgtgttaacagccccagctgtgttactttttcaatttcccactttacaacgagtttccaagagaaccatctggtctcagcttcctgttgtaggctatgcgggtgtgcacgtgctcatacatgattagcaaagtggtaaggataactgaatccccctgtggcaaacaattcggatacgacatttgctggatttgtgtgcatgtttacgtatgtgtataaacagacatctgtgtgtacacacagaaaagaaagaaaatcagaatttatagttcatggtatttgggttgttaaagaatgcatattaaagtaacagtgagatatgtttcatggctcaaatgataaatatgaaaaatacataaatatccaggtttagagggaatacaaagagtgtgctttggcatggtccatctgaagtaattggcagcatgtattaaaaaccttaacatgtgcttactctaatccagaattctttagtaatttgtcccaaagaaattattaaggccaggcacagtggctcacacctgtaatcccagcactttgggaggcctagaccagtgtatcacttgagctcaggagttcaagaccagcccgagcaacatggggaaaccctatgtctacattaaaaaagaaagagagaaagaaagaaagttaggggggagggagggagggggggagagagagagagagaaagagaaaagaaagaaagaaattattaaggacaaatgcaaaaatttagttccaagaatatcccatgatacattaagtctttaataaaaatcagagacaatttaaatgttcaaaacagtgaatcagttaaatcatgatacagtcacttagtggaatagcattagcaatgaaaaattatgatgtaaatcaggacttggcagattttctatacagggccagagaagaaccactttagactttgtgggccacatatggtctctgtgacatattcctgtctgtttttgttttttgcacagtgtcttttgaaccaccagagtttgagattgttggttttaccaaccacattaatgtgatggtgaaatttccatctattgttgaggaagaattacagtttgatttatctctcgtcattgaagaacagtcagagggaattgttaagaaggtaagtggcttctcctgttaggatcaaaacagttctgagtgggcaatcaatgcacttgactgtctcttttgaaaggaaatttgcagttgaacaattaaagctaaaacgtcaggcttcagtatggtccgacttagggaagaagtcactatggttcattcactattgatctaaacctgcagcacagtgttctttaaaagaataagccacggctgggcctggtggctcacgcctataatcccagcactttgggaggccgaggcgggcagatcatctaaggtcaggagtttgagaccagcctggccaatatggtgaaaccccatctctactaaaaatacaaacattagctggatgtggtggcaggcatctgtaatcctagctactccggaggctgaggcaggataatcgcttgaacctaggaggcagaggttgcagtgagccgagatcgcaccattgtgttccagcctgggtgacagagcaagactccgtctcaaaaaaaaaaaaaaaaaaaaagagtaagccacatgcacaacatcaaggaacacacaggagagagggtgtgggagggagatgcagagtacagccaaatttcagtgaaccctggagagatttatttgaaaaggagagtttagctgagccacccgtgaaaagcatctgtcgctgcctctctggccctcacacacagtaaggaagtggcttatctggcaggttctgtcctctcctaatttctgcaaaggacctgactctcagtaacctcagggttatctggtatcagacagccctgcatcttcaatttttgttgtccctagccctccaaatgctggaataagtggaaatggacaaattgctctcaccggtgtagcagcagcttatgtctgtagagccctttgccaagtataaaacccttgcaagtgagaccagcctgagagataatcagggtagatgcatttcaggcggagggcacaggaagttcaaaggctctgaggctggagtgggcccggtgtatttcagcaacagcgaggagaggtggctgaactggagtgaccaggcaggagatgaagaggaggtgaggtcagagggtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactatgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatattttgggttttgtttgtttgtttttgagatggagttttgctcttgttgcccaggctggactgaaatggcatgatcttggctcactgcaacctccgcctcccgggttcaagccattctcctgcctcagcctccctagtagctgggattacaggcacccgccagcacacccagataattttttgtatttttagtagagacagggtttcactgtgttggccaggctggtgttgaactcctgacctcaggcgatccacccacctcagcctcccaaagtgttgggattacaagcatgagccaccatgcccagctcataattctgcatatattttgcatgtggagcaagactaacttccccattaactatggaagatgatgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatctctactaaaaatacaaaaattagccaggcatggtggcgggcatctgtaatcccagctactcaggagactgaggcaagagaatctcttgaacccaggaggtggaggttgcagtgagccaagatcatgccactgcactccagcctgggcaacagagtgagaccccatccatctatctatctatctatctatctatctatctatctatatctgtctattgataaagggagaagatgagaaactagacatcagtcagttttgtcacagacaagctctgtgaccttggagaagttacttagccacactgagctacagttttctcatccgttgaatggaggtaatgcctattttgcagactgttttgaaagtcaaaagggttaatgtttatgaaggcactttctcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctacctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaattcagagcgagtccgtaaagtgaaagcaagtttattaggaaagtaaaggagtaaagaatgactactctatagacagagcagccccgagggctgctggttgcccatttttatgattatttcttgatgatatgctaaacaaggggtggattattcatgcctcccctttttagaccatgtagggtaacttcctcacattgccatggcatttgtaaactcatggtgctggtgagagtgtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccagtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcctggggctgtgtcatgggccattggtcactcatatttgactcagactgaatctcttcaagtatgttactgactttggctcttttcattgacaaagtgatatggtcacttgtgaatgaagtgagccacggaacgttgcctggcacataacggtgctctgtgttggcttcactacagggcaatatgatttgattctctagtgttcctcaagaccagatgatgcacaggctggttctaaaggaaaaaacatgtcaaacacctttagcgtaagttatttttatgtcagcaaatacaggcaaacttaaaactgcatatagattctgactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaactcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactcagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacgaaactcttatagacaataaaaactgaaattagtgacctggcagacagatggtggtttattgaaactcagtccccagttccaaggtgaatgtgttgctgatgagaaggcacaagctccttggaggttgatgaattctgtgatgactcactttctcccctgactcttttccatttcacctactaagatgttcatgtaacaacatcctctcaggtcattccatttttacttggcgtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatggagccgcagaccttcctggtgagcgttaacagctcttaaagatggcacagacccaaagagtgagcagtagcatggtttattgtgaagagcgaaaggacaaagctttcacaccctggaaggggacctgagcgggttgccactgctggctggaggtggccagcttttattcccttattgtcccttcccgtgttcgtttctgtcctatcagagtgcccttttttcagtcctcctcgtgattggctacttttaggatcctgctgattggtgcattttacagagcgctgattggtgcgttttagagtgctgattggtgcgttttacagaatgctgacttgtgcattttacaatcctcttgtgagacaggaaagtccctgattggtgcgttttacaatcctcttgtaagacaagaaagttccctaagtcctcactccacccaggaagtccagctggcctcacctttcacttagagaaggatcagctctgagagatatcagcagacacgtgcggcagcagtagtgggtgtgcactgactggaaaaggggacatgggcaggccacccacagcatccaccacagatggccacagatggccttcctgagaaggtagcatttgaataaagacccaagggagatgtggtaagcagaataatggcccccaaagatgtctacatcctaatcccagatatgtgaacaggctaacctctatgccaaaggggcttgtgggtgtgatgaaattgaagatcttggccaggcgcagtggctcatgcctgtaattccagcactttggggggccgagccaggtgaatcacctgaggtcaggagttcgagttcagcctagccaacgtggtaaaaccccatctctactaaaaatacaaaaattagccaggcgtggtggcatgcgtctggagtcccagctacttgggaggctgaggcaggagaatctcttgaacccgggaggtgggggttgcagtgagccaagatggtaccactgtactccagcctgagctacagagcaagactgtgtctcaacaaaaagagaagcaggagactcagaggcagagaaggagctctcacagcagcagcagaggtcgcagagtgaggatgaaggagggggccatgagcaaaggaatgcaagtggcctctagaagctgggaaaggcaaagaaatgggttttcccctagagcctccataaggagttcagtcctgccaacatcttgatattttttatcccagtgaaacccattttggatttctgatctccagaactattaatataatatatttatattgttttatgacactaactttgcatcatttgttacggtggcaatgggaaacaaacacaaggtgagggagtgagtcacgcaaacctatcaggggaaggagttccatatgcggggttcagcaagtgccaagtgcccgaggcaggatatgcctggcacggcacggcaggagtgaactgaacaagggaagaatagtaacagttctggtcagaaaagatggaggagcctgaatgacatagaacttagaagccgttgcaagagatggggaccctcagagggttgtgagcaggttgctctccgtgatctgacgtgggatgtaaagggaacatccatccacatgccttgaagtgggagccaggtgacccctgggctgattactgcagtcacccaggggagaggcggtcttacttgttccagagaggtaagtacgggaggaactataagagactgatgttagtcatcgccagtcttttcataaagttctttatcttttccattaaagatcattgtgatcagatattaccaaccccgttgctcagttcagccctctgcttgtgaggtttcttattttttgcttaaaatatctccacagtgaatccagagacagacaggtttgtccaaggccaaatttttaagacacgacctggtctctccttcccaagatgggttgatctggtccatctttcatgaagaagatagttaacagcagtaacattcaatcacagcttctcctttctgagtcagaacattgatgggattcatctcttttcaaatatgaatatttaaaaatagcatgcatgtataattgtcatgaccccaagtgagatttctattttttagattatcatcaagctgaaaacaaacaaaaattctaagttctcctaaagaattctcagactcatgagaataccccaaattgaggaatattatcctagcatattaactacaatttacacaatttggtttggacatagagtgcattgtagctgttatatgcaagttggatgggtacatgagtcacaatctctgtattatgccattccttcaccagtgaaatcactttggtttacagtacccctttcaagaatgtaaacgctatacatgtcagaattttgtatcctaaaggcgtgcctctgtggctagatctgattctggaactgtcattgatatgacaatccaatccttcacactcttgatggaggtgagagtggattcttgaaccctgtgctatctaacagtgtttttactgaactatcaagggtttttactgaacttctttctattcattccttaaccttctggaagacttagagtacataatccatttgatttccttttttctcccctctatctatttttgcctgaggctatagttcgaggattaatactaatgaagacctttctggaagtgcaagagagccttagtgatataactactgatttttcagtctggtcgcacttcaggaaaataactatggtcagtcaaaaagctgaaattttccaaaaggaattttgatgagaaactaaggggaactgttaatagagcaaggcaggttctgcagagccctgacttgtggccccagcgtggctaaagtccagcctcagaatgacccagttggttgttttcaagcaaactttccttccccacttcttcctgcccgcagcgcatgctaaccagtgtggctaccgaacgtttgagatgtgtttcatgtgactgagagaccgagctcttaattctgtttaattttaatcatttaaattcagccagctgcagccagtggctactccactgtacagtgcagttatagaacataaactgaaggaaattttacttttaaaagctaagtctattttattgtttaaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctatgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctga

SEQ ID NO: 1761 - DNA, 34590 bp, Homo sapiens
  source 1..34590: mol_type = genomic DNA
gcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagctgggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagacgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctgagattacaggcgtgtgctactacgcctggctaattgtatttttagtagagatgggatttccactatgttacccagcctggtctggaacttctgacctcaaatgatccacctgctttggactcccaaagtgctagtattacaggctcaatcatcatgttttatcaaagctaaaacccaaactaaaatgccattgcttataagatgcactttcattttatgtaatgaagtaagaaaaaacactgtcaatcatgctatgccatgccaccagaatgaaagcattctgatttcagaaattctcaaatgttaaaagaaaatgggcattttataatttgtgaaatattagtgagttagagcagagcttgacggcactggccctgagggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaattttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggccctttatgctgggtgaaggtgagtgagatgggggaaggttcactgggcaccaaccttctgggctagagaaattgcccaggctttacagaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatacggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaaacagaaggaaagacacagccatactttaccaggagactatgaggcagcgagttcctggagggttgtttgtctgtctaggaggagttggaattcaaagaatcacttcactcaatccatccattttatctgggccttgaaaattggcagggtttgtctggtctcagggtgaatagcaggtagagctcttctttcagaatggagaaggccacagtgtcacagggtgaacctgtgacaaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatgttgccatggcatttgtaaactgtggtggcactggtgggagtttcctttagcatgctaatatattgtaattagcatatgataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatttaacctaaggagcttggtgcattgtcaggcaacagtgagctacagactgagctcactacataattcacagggcccacccagagccaaataaaaatgcctgagaaagtaccactaaaggtactaaaatataaagccttttcttccacagtctctctctctcaacacgtaatgtttttttgtttgctatttaatatcattctaagtaaaaaaataggccgggcatggtggctaacgcctgtaatcccagcactttgggaggccaagtcaggtggatcatgaggtcaggagatcgagaccatcctggctaacactgtgaaaccccgtctctactaaaaatacaaaaaattagctgggtgtggtggcgggcgcctgtagtcccagctactctggaggctcaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttgccctggctgggcatggtggctcacatccataatccaagccctttgtggggctgaggccggaggatcacttgagcccaagagttcaagaccagcctggacaacatagcaaagccccatctctaaaaaaaaaaatacaaaaattagccaggtgtagtggcaaatgcctgtagtcccagctacttgggaggctgaggtgggagaatcgcttgagcccaggaggcagaggttgcagtgagccgagatcacaccactgcactccagcctgggtgacagagtgagaccctgtctcaaaaaataaagaagttgcccttctacaatctggatgtggtggtatctaggggaatgttcacaactaggcaacgcctctgctgtggattgattatgggagatgacatcacacatcaagatatctcagcagatgtttctcaatgggtacagtattatgggattagttccaggcagtcgtgcttggatatctcatgggtggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagcttaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgattatgactcaaaatttagaagctaagaaagaaaatacctttaaatctgaaaacataaaactcaaaaacttctgggtgtttttttgggggggttgttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccattctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctggagtctcccttctgggccccagagtggtcacaggcctcaatgttgtgagctgcagattctatactctcccttctggtttgcctacagccctctcacacatttgtaaatatagtcctgcaacccctaatgatgtcttgggcaaagatggaccttttatatgacgatagccccataagattataccatatttctactgtaccttttctgtgtctaaatatgttcagatacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgccttagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgagctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcagtgatctttaaaaatttaaccgtataaggcagaatttggcaagtctggctttaatgtctcatttatcactgccacttcccacctacatgacattgtataattcaactcagtttcacagtctgtaaaatgaatcttttcatagtgcctacttcagcattgttgtggggcttaaatgcttagaaagggccagtctgggctcatgttatactcccctgctctctgtgatccagggaataagtgagctggggaatccagaggaaggaaaatttgcagcgggctgagctacttaaggaggacttcatggaggagctgggagcagagttgagagaacggcttggggagggagaatgggtaggggagagtgaaaggaagtgcatcatgtgggctgggatggcctgggttattttggtccagtgaaccatggagggacagtccaagggcatcggagaagcccttctgtccagactctccttacacagtgcacagtccctgtttcccatgcttgcctgccctgacaatatgttgctcgttaattgacttactaatttatttcccatgtcctgtagacttcctgttttcaagacaccagggctctctggagaggttatctgccagaggtgtgggttctagatcccaagaaatgactgaacagtggccagaatacaactgtgggttccaaatttcaatgccctttttcttcttctctttagattacacagatgaatcttgcactttcaagatatcattgcgaaatttccggtccatcttatcatgggaattaaaaaaccactccattgtaccaactcactatacattgctgtatacaatcatgaggttggtttgatatttcattttctcttggtaaacatattattgttctgttatatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttatctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcagggaaggcattcataattgtcccatagaggaagggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagccaggatggtctcaatctcctgacctcgtgatccgcccgccttggcctcccaaagtgctgggattacagacgtgagccactgcacccggctcctccggcaagttttactgagcacctactacatgccagggggtccaactgtgaaccaaagtccctgccctcctggagcagacattatgtaaatggagacatcagtaaacaaaggtataatgtgacaggtgtgggtaaatgctacaatcaagaaaagagagggattgaaagtgcaggggtggggagggcataagatgttccattttcaataagatggttggggaagatcacttaatacaatgatatttgggcagagccctaaaggaaacaatgaagtaaggcgcccaaaaatagactctcattacatcaatgctaacaatttcctttttccatttttttctttccaaagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacagtgagttttatctctgtttctccacttcgtccccatcatcaagatctttattatttgctattccatgaaataggaggtctacaaaggtgttttagacctggggctgggctcacctcttggccctgccacttcctagctctgtaaccgtggactgctttgcttctctgagccttggttttctaaatctgaaaagtggaatgataatttgtactttgcagatttgccccgtgcctgtataaggcagtaggaactgctgttttcggttttgcagcctgacaggaagtctggagccaggttcaggtgggctggatctagcgctctcatctctctggcccaggattttctttctttctttctttctttctttttttttttttttgagatggagtttcactctgtcacctaggctagagtgcagtggtgcgatcttcgctcactgcaacctccaccttccaggttcaagcgattctcccacctcagcctccagagtagctgggattacaagcacacaccaccatacctggctcattttttgtacttttagtagaaatgtttcaccatgttggccaggctagtctcgaactcctgacctcaagtgatccacccgcctcagcctgccaaggtgctgaggttacaagcatgagccaccacacctggccccagtgttttcttaatacagcaactccaccccctcattataacccaatgttcttttgtgtgtgaacaccaagtgtgcatgcacctagtacccaaagctcagaggagaagactagaccccaagaacaggcctaccccttctttctttccctgtgactcaagtcagttccctaacacactgtgttaacagccccagctgtgttactttttcaatttcccactttacaacgagtttccaagagaaccatctggtctcagcttcctgttgtaggctatgcgggtgtgcacgtgctcatacatgattagcaaagtggtaaggataactgaatccccctgtggcaaacaattcggatacgacatttgctggatttgtgtgcatgtttacgtatgtgtataaacagacatctgtgtgtacacacagaaaagaaagaaaatcagaatttatagttcatggtatttgggttgttaaagaatgcatattaaagtaacagtgagatatgtttcatggctcaaatgataaatatgaaaaatacataaatatccaggtttagagggaatacaaagagtgtgctttggcatggtccatctgaagtaattggcagcatgtattaaaaaccttaacatgtgcttactctaatccagaattctttagtaatttgtcccaaagaaattattaaggccaggcacagtggctcacacctgtaatcccagcactttgggaggcctagaccagtgtatcacttgagctcaggagttcaagaccagcccgagcaacatggggaaaccctatgtctacattaaaaaagaaagagagaaagaaagaaagttaggggggagggagggagggggggagagagagagagagaaagagaaaagaaagaaagaaattattaaggacaaatgcaaaaatttagttccaagaatatcccatgatacattaagtctttaataaaaatcagagacaatttaaatgttcaaaacagtgaatcagttaaatcatgatacagtcacttagtggaatagcattagcaatgaaaaattatgatgtaaatcaggacttggcagattttctatacagggccagagaagaaccactttagactttgtgggccacatatggtctctgtgacatattcctgtctgtttttgttttttgcacagtgtcttttgaaccaccagagtttgagattgttggttttaccaaccacattaatgtgatggtgaaatttccatctattgttgaggaagaattacagtttgatttatctctcgtcattgaagaacagtcagagggaattgttaagaaggtaagtggcttctcctgttaggatcaaaacagttctgagtgggcaatcaatgcacttgactgtctcttttgaaaggaaatttgcagttgaacaattaaagctaaaacgtcaggcttcagtatggtccgacttagggaagaagtcactatggttcattcactattgatctaaacctgcagcacagtgttctttaaaagaataagccacggctgggcctggtggctcacgcctataatcccagcactttgggaggccgaggcgggcagatcatctaaggtcaggagtttgagaccagcctggccaatatggtgaaaccccatctctactaaaaatacaaacattagctggatgtggtggcaggcatctgtaatcctagctactccggaggctgaggcaggataatcgcttgaacctaggaggcagaggttgcagtgagccgagatcgcaccattgtgttccagcctgggtgacagagcaagactccgtctcaaaaaaaaaaaaaaaaaaaaagagtaagccacatgcacaacatcaaggaacacacaggagagagggtgtgggagggagatgcagagtacagccaaatttcagtgaaccctggagagatttatttgaaaaggagagtttagctgagccacccgtgaaaagcatctgtcgctgcctctctggccctcacacacagtaaggaagtggcttatctggcaggttctgtcctctcctaatttctgcaaaggacctgactctcagtaacctcagggttatctggtatcagacagccctgcatcttcaatttttgttgtccctagccctccaaatgctggaataagtggaaatggacaaattgctctcaccggtgtagcagcagcttatgtctgtagagccctttgccaagtataaaacccttgcaagtgagaccagcctgagagataatcagggtagatgcatttcaggcggagggcacaggaagttcaaaggctctgaggctggagtgggcccggtgtatttcagcaacagcgaggagaggtggctgaactggagtgaccaggcaggagatgaagaggaggtgaggtcagagggtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactatgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatattttgggttttgtttgtttgtttttgagatggagttttgctcttgttgcccaggctggactgaaatggcatgatcttggctcactgcaacctccgcctcccgggttcaagccattctcctgcctcagcctccctagtagctgggattacaggcacccgccagcacacccagataattttttgtatttttagtagagacagggtttcactgtgttggccaggctggtgttgaactcctgacctcaggcgatccacccacctcagcctcccaaagtgttgggattacaagcatgagccaccatgcccagctcataattctgcatatattttgcatgtggagcaagactaacttccccattaactatggaagatgatgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatctctactaaaaatacaaaaattagccaggcatggtggcgggcatctgtaatcccagctactcaggagactgaggcaagagaatctcttgaacccaggaggtggaggttgcagtgagccaagatcatgccactgcactccagcctgggcaacagagtgagaccccatccatctatctatctatctatctatctatctatctatctatatctgtctattgataaagggagaagatgagaaactagacatcagtcagttttgtcacagacaagctctgtgaccttggagaagttacttagccacactgagctacagttttctcatccgttgaatggaggtaatgcctattttgcagactgttttgaaagtcaaaagggttaatgtttatgaaggcactttctcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctacctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaattcagagcgagtccgtaaagtgaaagcaagtttattaggaaagtaaaggagtaaagaatgactactctatagacagagcagccccgagggctgctggttgcccatttttatgattatttcttgatgatatgctaaacaaggggtggattattcatgcctcccctttttagaccatgtagggtaacttcctcacattgccatggcatttgtaaactcatggtgctggtgagagtgtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccagtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcctggggctgtgtcatgggccattggtcactcatatttgactcagactgaatctcttcaagtatgttactgactttggctcttttcattgacaaagtgatatggtcacttgtgaatgaagtgagccacggaacgttgcctggcacataacggtgctctgtgttggcttcactacagggcaatatgatttgattctctagtgttcctcaagaccagatgatgcacaggctggttctaaaggaaaaaacatgtcaaacacctttagcgtaagttatttttatgtcagcaaatacaggcaaacttaaaactgcatatagattctgactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaactcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactcagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacgaaactcttatagacaataaaaactgaaattagtgacctggcagacagatggtggtttattgaaactcagtccccagttccaaggtgaatgtgttgctgatgagaaggcacaagctccttggaggttgatgaattctgtgatgactcactttctcccctgactcttttccatttcacctactaagatgttcatgtaacaacatcctctcaggtcattccatttttacttggcgtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatggagccgcagaccttcctggtgagcgttaacagctcttaaagatggcacagacccaaagagtgagcagtagcatggtttattgtgaagagcgaaaggacaaagctttcacaccctggaaggggacctgagcgggttgccactgctggctggaggtggccagcttttattcccttattgtcccttcccgtgttcgtttctgtcctatcagagtgcccttttttcagtcctcctcgtgattggctacttttaggatcctgctgattggtgcattttacagagcgctgattggtgcgttttagagtgctgattggtgcgttttacagaatgctgacttgtgcattttacaatcctcttgtgagacaggaaagtccctgattggtgcgttttacaatcctcttgtaagacaagaaagttccctaagtcctcactccacccaggaagtccagctggcctcacctttcacttagagaaggatcagctctgagagatatcagcagacacgtgcggcagcagtagtgggtgtgcactgactggaaaaggggacatgggcaggccacccacagcatccaccacagatggccacagatggccttcctgagaaggtagcatttgaataaagacccaagggagatgtggtaagcagaataatggcccccaaagatgtctacatcctaatcccagatatgtgaacaggctaacctctatgccaaaggggcttgtgggtgtgatgaaattgaagatcttggccaggcgcagtggctcatgcctgtaattccagcactttggggggccgagccaggtgaatcacctgaggtcaggagttcgagttcagcctagccaacgtggtaaaaccccatctctactaaaaatacaaaaattagccaggcgtggtggcatgcgtctggagtcccagctacttgggaggctgaggcaggagaatctcttgaacccgggaggtgggggttgcagtgagccaagatggtaccactgtactccagcctgagctacagagcaagactgtgtctcaacaaaaagagaagcaggagactcagaggcagagaaggagctctcacagcagcagcagaggtcgcagagtgaggatgaaggagggggccatgagcaaaggaatgcaagtggcctctagaagctgggaaaggcaaagaaatgggttttcccctagagcctccataaggagttcagtcctgccaacatcttgatattttttatcccagtgaaacccattttggatttctgatctccagaactattaatataatatatttatattgttttatgacactaactttgcatcatttgttacggtggcaatgggaaacaaacacaaggtgagggagtgagtcacgcaaacctatcaggggaaggagttccatatgcggggttcagcaagtgccaagtgcccgaggcaggatatgcctggcacggcacggcaggagtgaactgaacaagggaagaatagtaacagttctggtcagaaaagatggaggagcctgaatgacatagaacttagaagccgttgcaagagatggggaccctcagagggttgtgagcaggttgctctccgtgatctgacgtgggatgtaaagggaacatccatccacatgccttgaagtgggagccaggtgacccctgggctgattactgcagtcacccaggggagaggcggtcttacttgttccagagaggtaagtacgggaggaactataagagactgatgttagtcatcgccagtcttttcataaagttctttatcttttccattaaagatcattgtgatcagatattaccaaccccgttgctcagttcagccctctgcttgtgaggtttcttattttttgcttaaaatatctccacagtgaatccagagacagacaggtttgtccaaggccaaatttttaagacacgacctggtctctccttcccaagatgggttgatctggtccatctttcatgaagaagatagttaacagcagtaacattcaatcacagcttctcctttctgagtcagaacattgatgggattcatctcttttcaaatatgaatatttaaaaatagcatgcatgtataattgtcatgaccccaagtgagatttctattttttagattatcatcaagctgaaaacaaacaaaaattctaagttctcctaaagaattctcagactcatgagaataccccaaattgaggaatattatcctagcatattaactacaatttacacaatttggtttggacatagagtgcattgtagctgttatatgcaagttggatgggtacatgagtcacaatctctgtattatgccattccttcaccagtgaaatcactttggtttacagtacccctttcaagaatgtaaacgctatacatgtcagaattttgtatcctaaaggcgtgcctctgtggctagatctgattctggaactgtcattgatatgacaatccaatccttcacactcttgatggaggtgagagtggattcttgaaccctgtgctatctaacagtgtttttactgaactatcaagggtttttactgaacttctttctattcattccttaaccttctggaagacttagagtacataatccatttgatttccttttttctcccctctatctatttttgcctgaggctatagttcgaggattaatactaatgaagacctttctggaagtgcaagagagccttagtgatataactactgatttttcagtctggtcgcacttcaggaaaataactatggtcagtcaaaaagctgaaattttccaaaaggaattttgatgagaaactaaggggaactgttaatagagcaaggcaggttctgcagagccctgacttgtggccccagcgtggctaaagtccagcctcagaatgacccagttggttgttttcaagcaaactttccttccccacttcttcctgcccgcagcgcatgctaaccagtgtggctaccgaacgtttgagatgtgtttcatgtgactgagagaccgagctcttaattctgtttaattttaatcatttaaattcagccagctgcagccagtggctactccactgtacagtgcagttatagaacataaactgaaggaaattttacttttaaaagctaagtctattttattgtttaaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctatgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaa

SEQ ID NO: 1762 - DNA, 32832 bp, Homo sapiens; identical to SEQ ID NO: 1760
  source 1..32832: mol_type = genomic DNA

SEQ ID NO: 1763 - DNA, 4972 bp, Homo sapiens
  source 1..4972: mol_type = genomic DNA
gttgtgaacttacactttattcatatatattagatattgataattttaacaaatgagttactttccatttgggtacagtcacagttgtcaacaatatttggaagcaccaggcatgaaatctcctgagatgctatgttttcatcagggtcacctgacacattcaagttctgtctgacatgccattaaagcactggctcagattgcaggcatattttcaaaccggcagtaactggatagtatcacttcacttataagtgttcattgtatcatcaagtgaaataaacacacaacccatgggatcttgcttaggttggctgcctagttggcccctgagataaagccttgtaatcacatagccttgcctaattagtcagaaaacaaaggattaagtgagacagtcacaggatataggaattataaataatacatatattaatagatattcattttcattacacaaaagttgctattataaatacttatttgattgatgagtctaaaaatatattccccatataaataatgttaaatattaataaatagatttagatttaaaattcaaatattgcaggcaggacaaccattactgggatgctcttcgacctcgaaacagcatctgactcctttttcgcttccctgttttagctgctggcgacagttcagccatcacttggatgagttcatgtattgctttgcgttggacattcaagtcagttacctatcgggaaagaaaagagcaaaattaatttcaggcatataagccatcaggatattctgctaatgtcatgatggtcagtgaaaataaaagtattcctttaaaaaatggaccgtattaccttaatatacaatatttacttcttcagcagttgaagctaaaaattacaattacatttctagttgtgctataatgtggtggagtccatcacatatctttaaatctacttctatagaattcttgaaattatatagtgaaaagactcctggttgtggagtcagcataaaaaggtgggtttgaatctcatgcatgcaataattctgaccttgagccagctacttaacctctctgaacttctattttctcatctaaaggaggatgagactgtttctatgacctctctatcatcaatctaccaattatatcactttatacttcagtctttcctgtatgcatcaaatgagtaactataggtcaatgattctcactgttgtgcatagcagattaatccggaaacctgtcaaagacctcagagatccaggtgcatgaagtggaaggactgtgccctgtgcattcactaagctccccaggtgattctgacatccacctaagtttgagaaccactgatctaggttaggtaccctagaaaacaccaaatccaaaacgagtgaaaactgtaatttttaatttctcccagattaggtcagtctctcaatttccataatagattttaaaataaacacccccaatcatatttatatatggcttactgatatataaagtttaaaattaagaattgcaacaacttttccagtaccctgccttctaggcaagcaaattgaactacttgcatctcctcactctaaccaatagggccatttagatgatgcttcataaaatgtggaccatttaccttcctcttggctctgccattacattttttctaatcttgggaacactatggctactcaccacatttctgaggatggctgggggattacagctaaagactaattgtcaaagggcataacatgcataaaatagcttagcaactgagccaaagagaataataattaatagagctcactcaagattgcccatcaagaaacaggaggtttgtagcttccagaaggaagaaaccacagattttttttcatttttttaaggcccagttcctgcagagtagaaaaaattttcgacaagctgtgtgtttgcaagtgacagattttactttccaatgttcaaatcatcaccaagaaactaagagacttatccaggactgaacagtaagccaggggcaccactggattagaaacaagtgctgagtgtctagtttataaccaaaggagacctgttgccatgtctctcctttctgtttctgggggcttacatgagaggagtgagaggcaggcccagcaatagtgaaagctgagcacatatcctaagaacacaaatgctagcttgaagaccctggtccctctcatttgagcccatttatatcaaagtcaaccccaaaggaatctagaggcctttgtcttctagaaaacattttgaaaaacatgatttgtctttatgcctcaacgttatctttctgtttatagaagccataacttaaagatacaagttcatgaggtaagacttaggagtctaaggagttctccagctgagatattctgaaagttgatagagagttgatagaacaatcttttcataaggtataaattctatctatttttccctaaaaacaaacaaacagcaaccattcttgcttctaattgggcagtacaatctgataggttggctagagacttgcagtggggtgtccctggtacctattcaaagactgtagctttcttctatctcattctcattttctattctttgcattgtagagttttggagcaaagaaggtcatcaaacttatacagtgagcctaacagtttccttttaagatgaggaaactgagccccagccagccatgtgattcatcacagttccttggtggctgagttgggaggagaacacacatcttctcagctcctcccactgctctttccattaagacagacagcctctcattcaaagtaagagaatttccatcatatgagcaagggacaatgagagaactgcttctcagtactccccgcttcttcctcacctacttcctcttcactggatttgtcaactcacctgtctttacgcaatagttacaatgccagcatttctctacattacatacttcagcgattctcttactggctttgcaaagtcacccaaacacgaatggaaatagtaaggtagagtttcagccatgagttgagttcatagctttagcaactgttaaatagctaatgtctactttctggagaataaatgctttgcaagaccctcggcaatgaaaccaaagaaagaatttaaatagcctcaccgaataattagtcagcttttcgaagtcatctcgtttctttttgttgctattgaaaaacttgacattcatgtcttccttgatggtctccacactcttttggatgctctggtcatctttaaagtttttaaaaagtttgaagtaaaaggagacaatttggctctgcattatttttctgtcactctccttggaaggaaagagcacaaacagaggatgatgtgaatttatccatcagaaagcaagcaacaggaaaattagccaaatgggaatattcagcttacctctttccaattcttcaaaatgcctaagaaaagagttccattatccgctacatctgaatgacctgcattctaaaaaaaaaaaaagaaaaaattggtttacaattagcccataaattgccttaaaaatatatttcaagtttcattgaactcagatgtgacaatattcactgatttccttttcaactcttctgcttagttctaacaataagtattcccaaaaggcttatgtgagatatagacaaagactattatgttcttttagcttttttatttcccaatataaccattaaattgcaatgtcacaaatgagctcaacaaagctgatactccaaaggtcccaaaaactatagtaagctaaagaaagtattttcaagctaggctaaaaaatacaaaaacaaaaaacagcaaagccaccccactataaaatactgccccccaatggtacaggtttctattacatctactgtgccttcctgtagggtattattatacgagctttaaaagatagttccaaacatgtgcgagtgtgtgtgtgtgtgtgtgtgtgtgtgtgatttgattttgtgttgtaagaataaaatcaattgtgaatgtctgaatattattatgacagctataattataacagctaagttttaaacaaataatgaaatatttaaaatgtaaaaacttttcattaaccatcaataaaattttaaaagaaactcaaaaaattcacttaaaatttttaaacattccttagccagaatcataattcttccaaaatcccagtgagcaacgaagttccggaatacttcacaagtaatatagatagagaagcagaatgttgaaatcactttttggagaaaatcacctatcagttatttttttaagccaaagctttaaggacctttttgactttaatttgtaaacatttcctattacctttttaatgctaatcttgaccttagagtctgagaagtcaaaaactaataaccaatcatttttttcaatctgcatactccttgactatcacaactgaatgagttcccaccacaaaattattaacatcattatgcttcatacccatattatgcccatcttttggaaaattcataaatcccttttaagtctctatacaaactgagcagaaggttaaaacaatatctagattatttagtcaaggaactcatctagtcaataattaacaaaataacaccaaatctcaaaatgactgcctacaagagatgacagcctatcagagatgctacagcaagtcgatattcagtcattttcaaccacaaacaagtactattaaaaagtcatacttacaaaatatttcttaaggttttctgcttcttttacatatgggtcctggcagtaacagccaagagaacccaaaacgatgcagagctgaaaagccaagatataacttgtatatttcatcgtttccgagagaattaagccaaagaagttgaaatcagtagttcttgtatcaagctgatcaggtccaaaggacttaactgatctttctcttctaatagctgatcttcagatgatcagaacaatgtg

SEQ ID NO: 1764 - DNA, 21947 bp, Homo sapiens
  source 1..21947: mol_type = genomic DNA
cgagttttaaaattctttatttaaaaatctctaactgtaatgtttcataaaaaatatacacgtttctatttacatattccattaattctattagtttgaattagattttaagtccaattttgaaaagcttgcagaatttcttctgaaattacttaaaattactgtatgcataaacttacaaaaacatatgctataccaaggcagagaaaagaaaaaaagtgaagtggctacaaaggtccctggggcatcacctgctcacctaggaaccaggagtactggatactgttccgttactggtaacctatctggatgtaaaggttcataagttacaatgctttttttgtttaaaaaaaaaaaaaagtctgtactttacaagccaaaagtgaaaatgccacacatcctctttacgctttcatgtacactaagtcactccatttggttgataccaactaagatacaatttctgagatcataatcttttcatgaaattaaagcagaaaactgtccaggaaaatcagacttcaaagttggtgcaacttagctgatctcatgaaaattctttggaatcttctgttggtctataaccaatcaaggactctttaccgctatcatccacaagtagatccactagcacatgtggtttatcataaccaaaggaggtgggggcttttattacggttatgagctcttgtccttctgtttttatttcacctttattatttgggggaaattctgagtcagataaggagctatgtgattccagacagctggaatcagtatcaaaaccatttctggagtgatcactctcagaacaatttctggagtgatacgagtttaaagcgatgctgccaggttcagactggttactacttaaaggtgaagaactctctctctctattggagtcagatggctgcccgggaccacgtcaggaatattttcttcagtagtcaccacttctgttatactagaaagttcttctgtatgttccacttttcctggattgtcttcggtatgcatgcctggaactgttgctggagacaacggctcttcacagaccacctccttttctaaggaaaatggctggtatgacgtgatgagtgatacatattttgattcaggttttgtctctaaagtagcacttcttaccacagagatctatggggagaaaaattgattaaagataaaaaattgttaagcttaagtgcctaccctcaaaaaaaacaaaggtctgaagtaatggaccaccaaatggcacatttaggataatgggtgaatcagatgttgccatttctttttaatgaaaggtcccatagtaatattaaaaacaaagttttagaatttttaaaaagccatcagatatcttactaatatatgttgctttttgtacgttactgtgatggttaatactgagtgtcaacttgattggactgaaggatacaaagtattgatcctgggtgtgtctgtgagggtgctgccaaaggagattaacatttgagtcagtgggctgggaaaggaagacccgcccttaacccgaatgggcacaatctaatcagctgccagcatggctagaatgtaagcaggcagaaaaatgtgaaaagagagactggcctagcctcccagcctacatctttctcccatgctgaatgcttcctgcccttgaacatcggactctgaattcttcaagtttggagcttggactggctctccttgctcctcagcctgcagatggcctattgtgggacctctgatcgtgtgagttaatactaaataatactaaataaactcccctttatatatatatatatgaaaaatataattaatatatattatataatatataatttataatatataatatataatttataatttataatatattatataaaatataatttatattacataaaatatataatttataatatattatataaacatataatttataatataatatataaaatatataacttatattatataaaatatataatttataatatattatataaaatatataatttataatatattatatataatatataatatatattatataacatataaaatatatataatatataatatataaaatatagatttatataaaggggagtttatttggtattatatatatatctttatatatatattccattagttctgtccctctagagaatcctaatacaattatcttccacatgtacgcacattatgtttacaaagtgggcacatctacttaagtaatattctcattacttgccttcatcattataatttttagtagctcatattatttctttatactgataaataatttaatagatggggaaatgtttccaatttttactagctatggaacatgttaaatatcctgtacatctttttatttatgaaattatttccttataatacattttttaagagtggagtgaccatatcaaagaaatggtatgtttacgtcactattacactgaatacccactgtgtgcttttattcttaccagggctagattacttttcaccagcatttacccgttatgctactgctggtactactggatatccaggtttcttttttcttctctagcgcgtgtaaaatggcatactgcaaggttactttgtgcttaattactagtaagaataaaatattataattcatttgtgagttgactactaactgttgagagttcttatccactttaaaggtagtttatagcaaattttaatgtgccctttgagcatcacagatattattcctgtcatatttgactcaaatagatactattctgttacctttaaatgttctttacatcaaaggctttgaaatgttggacattaaaatcgtcaaactcctacgttagtctcatttttggccaactttcctttcatactccaaccataatgaagtgtttctgtatttgcagagctttcaaagtcatgctttcttggctctggacctcagcacattctgtcccctagtgcctaaactcctgtatgtccctcaagactgctcaggcattgcctctggaaaagccatgactaaccccaccccaaagctggacaaagtcctcatgggctcaggtataaatctttgaatctatcacacgttatatagccaatgtatatttatcttttcttccccctagactttaagatctttaacagaattgtctcaccgtgtttttccctgagaataaaaaaaaaaacaaaatacttgctgcacagcaaaagacacagtatgtgattttgcatgtgtggtagactgactgattgatggcaggtgacatcttgttgaatatcattctactttaaaaacataatttaagaaactatcaaaaaaggttcaagttaactttttagtgtatataaaaaaattaaatacattaccaaggacttgggtaatattatgcttttttccttcaatggattaattttcttaatataaaaacagatgaataccaggctaagcactagaaagagtagtaaagcagcaacaactggaatccaaagagaaccttaaaaaaggcagaaatcacaagttacaattaagatggaatactgctattatctatcaaaaagtcttagtgccattcttgaatagatttacaaattagtgaatagggccagagttttaaagaacactgaaggaagcagaagttaggaaatctgagtaaaaaattaggtatctgtcttagatagcaatatggttcttcccagctctgcaattctagaactttctgggactattctactatgacacaacatagttaaaatagcttttctacaataatttccttacagccctacatacagtgtgtttccagggttatgcatttctttcggttaaaaatgcaaaagaataattttaaaaatacctctccttagaaacaaattctggcagctgggcacagtggctcaagcctgtaatcccagcactttgggaagtcgaggtgggcggatcacgaggtcaagagatcgagacaatcttggccaacatggtgaaaccccatctctactaaaaatacaaaaattagctgggtgtggtggcatgcgcctgtagtcccagctacgtgggaggctgaggcaggagaatcgcttggacctgggaagtggaggtagcagtgagctgagattgtgccactggactccagcctggtgacagagcgagactccatttcaaaacaaaacaaaacaacaaaaaaaaaaagaaagaaattctggcaatgtttattgctcttaagatgatttagccccactcctcagaatttcctgttacatttatttcacgactgcaaatacttataaagcttcacagatgtacatgcacacagcaatgctgcacaggaataaagtccccttagttataaaccagacataaataatataaaataggaaagatttgtttccaagcacatacatctagaatcaccattgtgtactttgctgtaatgctgccttttatttttgcagcacaatcttcagtattttttttttttcatagttctctcttccaaattaacagcactctaacatactgtgacaatgtccggcatcctttagggcattttgttacccagaattttctaactatggaagttactaatgaatgcttctattacgcttattacagggtgtgaaaaaagttaaatcattacaaaagtaaaaaggaaaataactacaaaaccaacattagtgctgttagaagtcccacgggctgagcaagtgctggctgcaaggcattgaggcaagcaggcagggctgctgctcaggagccacggcaatgccaccgtgtggccatactatcagtgcagtgtataattcaggctaaaaacaaatctgcggcatttgcattatttcaaattttgagcattaagaagggttttatttttcaaatagcataacgaaaattagcataaaatgcattgcactgctttaaatcacctatttgaaaccttcatataatggcttgaagttattagtattgaattttaggtgtttgttctggctcttcagcctatatttccattcctcgaaaatatacttgcatcataaaattttaaacctatgaaatctattctaaaaaaatcctaaggaaaaaaatatatgtatacacacacacacacacacacacacacacacacacacacacacaaagataatcatcaaagcatgagttacaatatatgcttaaagcaatacacaaaatcatatatactatacaatatgatcatgtctatgtagaaaaactaaagaaaatatcaaactgtgaataatggggtatttttgcatggtagaactacagattattttgttttcttctggtttttcatattttataaattatctataatgaacacttacatttcctaactgcaaagaaaagtccaaacttctttaaggttcctgacacctgagagtaacagttctaaagttcaagttctagcatatatatctctacctccccaccccccacattaaaagatgaaataaaattaattattgtaaaatgttataaaaatgacccattatctattattcaaacccatctataaacttttttggatattaatctcgagtctttgtccagtccacgtcatacagttgtaaccagtgatcgttcctgctcttcagtctttaaattacaatccccataaagaacattttagtggattcacaacatcttgctatggtgaagtaacaaactgacttataattcataatcctgaaatgcaaacatttgtgtagttttatgtacttattatatattttttctttcctgggtcaaggggccatcacatggctttccaaattagttgttctatatctttaaatgtgtgagaaactgctttatttttaattttgaacttctctaaggaatggaactaatgcaaatgaatattgttaaaacagatcttttgaaactgcaaatgagtttgctttcctcacatgatcctattttagttactgctccctctatatttagaaaaaaaatggcaagaacttaccttttatactgctattgaaaatggtaatacaaacttcttttgacttttcagttgtaacaccccacacatgtaagactccttctgctgaaacacagtactgagaattcagtgaggatactggaatcgctaactggcactgaatctcgtcacaatcatcttccttctgcgtgagtattttatactggatctagatgaaaaaagaaaacagtgaaaatgcacagcttcttttaatctgaaaaaaaaaaaaaatcaccatattagtcctggtcaaacaactgaagaaatatatatgattgacttgaacatgtctaaaaatagctttactatcaataagtcaatttgttacttcaacacagcacgatactatgcatctgttatattccttataaaaatggtaaatttaaaaactcaaattgcaggaatgtttattgttagttgttaaactaacaaatgttcatttgtcctattcatttgtccagaaatttagctggtgggaaacagaagtattaatattactttacgtcaccgccaatgaggaagaaaatcctcattttaccagtggagcaatggaggtgtactgggaaaaatcctagattagagccattctgctaaatgaagcaaataaaaactaaatgtattcacatggtcagtgttagtgactaactctgtatcatttttgctttaatagcattcacatatttttcttatcaaatctatgatctgtgagtcttgcttgaatatttataagcatcctattttcattacactacagaaaggaacaacttttgctagctacacaagaatttccattatgaaaaatgtgaaacacatacctcacttccgttcattctcacatacacattgtacaccctaatgtaacaggtagtttcgggatcataatcgacttcctgctcgtctccatttacaaaaactgaagggtgaaatatgtcaatcatgatttgcttctcctcctttctgatatccagtttaggtggtccaatttttcctggggaaggaggaggaggaagtataataaatactggccttggaactaaatggtacatttcataaaattaccagaatctatcaatcaacctattgtttttgttctggttgttctaaagcaggaccacatttaaaccactccacaaatatctagaagatagtctcggggtccttaataaacaaatgtttcataaatctcaggcaagaagtactcttatttaatctgaatgcctatttagcagtttaatttcatttctagttgtaaataaaaatagttataaactttggttaaaaaaagacttcacataatatagactctattaagtaatttttcctttatctttgcttctgtggattaagaagcctggattctaaaaaacgtttcagaaatggcattagttttcttccctcatcaaaactctttttactgtgaaaaatcagaacttattccataaatatttattaggtctttgatgtttgagactttgttgtgaaccatttatctagtcttcacatattactgtgtaccactgtgtgccaggcaggtctgtttttaacccatcagtgtatcctcagggcccagtatactttccggcacgtagtaggcccttgataaatctatatggaaaaaaatctaacatgcagatggtgtggtaatcatatgacaaaattgtggactctggggaagaaaagtatttaaagggtaaggagaggaagagcctgtagaagagaccgaggtggcacaatctaaaaggcaggagcagagaaaggaagtgaggctagagggaaagggacccaagggctagaagactagggaggagtcaagtgactaaaggtgtcttttacccaggagtcagggtctgagagctaaggcaggatgtcatagttggaatacaggaactggaattaaagattcaagagtttgaggtgacagcaaacatcaggtacactatgggagtgggatgctggaagactgaagacctgaaaatcacagtggctgaagagaataaggaactctgcaattttttaatgtattaaggtggtattcaggttccccaggcattcagaataagagttagctgccaaagtccttagtgaatataacttacaaatgaatgacaaaagatgggaagggcaagggtggtgcaggggaccgctgggcagcacagacccataattgtatgaagtggaaatgtcatggcatagaagcagctaagtgatggccacctgttagccctattttgtggggcttgaaagaaggggaggatacaggttgagtatcccatatccaaaacgcttgagatcagtagtattttcggtttctgagtttttttttctggattctggaatatttacattatatttaccagttgaacattctaaatctgaacatccaaaatgctccaatgagtatttcctttgagtgccatgctggcgctcaaaaagtttcagattttggagcattctgggtttctagacttgggatgctcaacctgtactgactctaaattcctccaagtgtttcttaagcattgtgataattttcagcaactgctaataaaagcaaacatacagaagacatgtataaatattttccaatttaaaatttacatgtgtacacattctactcaccatctcggcatacagcaaattcttctgactttgcataggcagattctttttgtccaaccctggctttaactctgacccaaagagaatttgatggatcaccaacatgatcagaaatattacaataatgatgagaaatattgatgcaggcatcaatccattctgaattcttaacactaaaaagaataaaaaaatgcgaagataacttttattgttattaaataaactcaaaccatttctgtctgtgctttgctttttattcacagcacaaagcggtagaaagagcagagctaagaataggatggagacgccagagaaagtaggaaacccttactctttagttagaagaactacaaactctgttacagtaaagaggctcaattcaaaatgtaagacctatgcaagccacattccacattcaattttttaaaaatctgtttttttaaacaactctaaattccatttatatatgttaattatagaagtaagcacattaaaaaaactaacagttgtcaaaaaagttttttgaaatttatattgttctactaaaaatacactacaggaagatgacatagtaactattagctttatttgtcatgctaatctcagaagtttagtgatacttctctatttcaatactgataaggaagaggaaataagaggcaagaaatatttggcaaagaatttgcatctttagtacttttggacctctataagcagtttagaatgttttgccacgtgggaaggctgatgaaagaacacagttgtggaatttccaaggacctaaacaaaaatggaataaaaaggataaataaaagagtgacactcacccatagttctttacctctacggtaaaaacagggacctgtggcatgatctggtactcccaatatacgatagggttcatgttataggattcaattgtaacattagttggtgtaggcactgtaagaaaataaaaaagtaaaagggacaattgtaagaaactaacattaatattggaaagccttattgtaagatgccacattgcccagatatgtatatttgaagaaaagtagaattcaccaggataccaaaattatttaaatgaagagtagacatctagaaattaattttattgaaaaatctatagaagagttctgattcgttttaaattatggaaacatcattgcaatataaaggaaacacaaatacagcatgaagcaataaattcccttaatatgatagaagttttataatcaaatgcactgattattgaattaataatcctcatttcatcactagaattttcaatatttgatactacagattgtattcaatgttgatagggtttggctgtgtccccacccaaatctcaacttgaactgtatctcccagaattcccatgtgttgtggcttggacccagggagaggtaattgaatcatgggggccagtctttcctgtgctattttcgtgatagtgaataagtctcatgagatatgatgggtttattggggcttctgctttttgcttcgtcctcattttctcttgctgccaccatgtaagaagtgcctttctcccccgccatgattctgaggcctctccaaccatgtggaactgtaagttcaattaaacatctttttcttcccagtcttgggcatgtctttatcagcagcatgaaaaaggactaatacagtaaattggtaccagcagagtggggcattgctgaaaagatacaagaaaatgtggaagcaactttggaacagggtaacaggcagagactggaacagtttggagggctcagaagaaataggaaaatgtttggaactttacttaagagacttgttgaatggctttgcccaaaatgctgatagcaatatggacaataaaatccaggctgaggtggtctcagtggaggtgaggaacttgctgggaactggagcaaaggtgactcttgctatgttttagcaaagagactggcggcattttgcccctgccccagagatttgtggaactctgaacttgagagagatgatttagggtatctggtggaagaaattactaagtggcatagcattcaagaagtgacttgcgtgctgttaaaggcattcagttttataagggaagcagagcataaaagtttggaaaatttgcagcctgactatgagacagaaaagaaaaacccattttctggggagaaattcaagctggctgcagaaatgtgcataagtagcaagaagcctaatgttaatccccaaggccatcgagaaaatgtctccaggccatgtcagagacattcacgccagcgcttcccatcacaggcccggaggcctaggaggaaaaagtggttttgtggccaggcccagggtccccgtgctgtgtgcagcctagggacttggtgccttgcgtcccagctgctccagctgtgactgaaagaggccaacatatagctcaggctgtggcttcggagggtggaagtcacaagccttggcagcttccacatggtgttgagcctatgggtgtgcagaagtcaagaattgagatttgggaacctctgcttagatttcagaagatgtatggaaatgcctggatgcccaggcaaaagtttgctgcaggggcagggccctcatggagaacctctgctaggccagtgtggaaggaaaatgtgaggtcggagccctcacacaagtccctactggggcactgcctggtagagctgtgagaagagggccaccatcctccagactccagaatggtagatctgctgacaacttctggaaaagctgcagacatttgatggcagcctgtgaaagcagctgagagggagcctgtaccctgcaaagccacaggggcagagctgctcaagaccatgggaagccacctcttacatccgcatgacctggatgtgagacctggagtcaaaggagatcatttcggagctttaagatttgactgccccactggattatggacttgcatgggctctataactcctttgttttggccaatttctcccatttggaatggctgtatttacccaatacctgtacccacactgtatctaggaagtaactagcttgcttttgattttacaggctcacaggcagaaaggacttgccttgtctcagatgggactttggaatgtggacttttgggttaatgctgaaatgagttaagactttgggagactgtttggaaggcatgattggttttgaaatgtaaggacatgagatttggaggggccaggggtagcataatatggtttggttgtgtgtccccaccgaaatctcaacttgaattgtatctcttggaattcccacgtgttatgagagggacctgggggaagtaattgaatcacgggggctggtctttcccatgctagtctcgtgatagtgagtaagtctcacgagatctgatgggtttatcaggggtttctgcttttgcttcttcctcatttttctcttgccgccaccatgtaagaagtgcctttcgcccttgctgtgattctgaggcctccccagccatgtggaactgtaagtccaatcaaacatctttttcttcccagccttgggtatgtctttatcagcagcacgaaaacagactaatacaaatgtctacagaggaactggctacaatgaggatggccaatttcactctaaaataccatcaacctctcaactctacacatactactatttatgccttccacactttttctatagtacaggaatagatacctaaagattgaacaatggagccacacattccagtttcatcaacactctgctctctggggtgtgcagggctttttacaaaacatacccaacatttcttcttgccttcactctttcagaaaacatctgttgataagacttgagtcacgtaagagaacagacagaagtcattttaacatctaatcagacactaccaaaatctagttattaaaagtagtcatgggccaggtgcggtggcccacacctgtaatcccagcattttgggaggctgaggtgggaggatctgttgagctcaggagttggagaccctgtctccgcaaataattaaaaaattagccaggtgaagaggcctgtgcctgtagtttcagctactcgggaggctgaggaagattgcttgagcccaggaggtcaaggctgcagtgagctgtgactgtgccactgcattcagttctcttagaaaaaaaaaaaaaggagtcatttttccccactgtttggtgtaaaaggttgttatccaacaccccttggaaaactgaacacacacacttctcctttctcccttcacttctttacagataaacatgaatgtacacagttagcgatgtgaccccaaatttatggttattcaatctcacctccctggaacactctattaaacatgatttacttatataactaaaacaaataaatgaatgtccatgtggataggaacagtggcttccaaacataacttataatcatcctcaaaaattgtgagagggacagaagtttctatttttccaaagtgccttggatgataatgatgatgatttatatttatatcaagcagactgcttaaataagaaaaatactccctaggtcaaacattaataaatttgggttctttcttggccacactgctaaatacttcagatttcctgatctgtcatgaggtgttactttcatatccctaagatatttgcttactgctgaagggaaaatctatattttccccaaacaaaaattccaatattcaagaccaaactggtatattgccttaatttacaattatttaacacatatattttcaaagcagaacatggattaagagttttttaggtaaataataggcactaatggacaattaaatgctatcaccattattattttccttttctgattattttttcctttattgcagtggttctctgtgggaagtgattttgttgccaggagacattaggcaatcaatgtctgtagacatttttggctctcacaacctggagaagaagtgtgtgggggaggtactgctggcatctagagggcagagaccaagggtgctgctaaatatcctacaatgcatcagacagcctccacaacaaaaaataatatagccccaaatgccagcagtgccaaggttgagaaaccctgctttatgtttacaatttaagtgttctttaaaaaaaaagttgaggaaaaactaacttaaaaacagaatgctttacagtaaacctgtatatttcatggctcccctcaaacaaatgaatagatttggttattgccaaaagatctaacttctatattatttaccaaaatggtgtaataatttgggccaaaaggttgagattatcaagctggggagggtctgaagattcaaatacttcatactactaacttgacctttttgtggccagtgaccagacacctaggttttctccttctgcttccagaggcgcagctgaaggctcttggtacctgccatctctggttctctaagcaacttccttgtaggtgatccctaaggcactgttcttgccagagtagccttggctctttgttttttgtagagttcccatggccattcatagcaggggatactgaggcttccttaagagggtcttttttctatcacacgtttgcatctcaacctcctgaaacaactcaaatacttcacaatccatattttaggtagaaataaaagtcattcctcttcacctgggttcaatcaacattaatatcaaataacaatcacacatataaatatactttttcaaccggaaaacagaggtacttgatgctaagaaaactcatactaaatctgagccttccttcggagaccatttcttcattttggcatttttttgcctctcgagaggctgagaattttcaaaccaggtggtcctggtttctttttaacagttcttcccatgattgagcaaagtctcacctgttactataagacgcaagaagaaaccaggtggcactttcagcactctggttagaaacctcctgagctagatcacacagctcctcagacattctctacttttggtgtcactgaaggctacagtgtcactcagctttctgccactacatagcaaggaccccccttcctctaggtttccaagactggaaatcctttgcttccttttaagctccactcccctccttttgagacagagtcttgctctgttgcccaggttggagtgcaatggcatgatctctgctcactgcaacctctgcctcctgggttcaaacgattctcctgcctcagcctcccgagtagctgagattacaggtttgcaccaccagacatggctaatttttgtatttttagtagagatggggtttcaccatgttggtcaggctggtctcaaactcccaacctcatgaatcgcccacctgggcctcccaaagtgctgagattacaggtgtgagccaccgggcccagcctaaggctctctttttaattatacccagtaggaatggctttataatggtatacgctcaacctgaaattcctgtgagaaaaaggcatatagaagtcaatctgcatactagaatatcaaacaaagtgcatttgtacttaggaaggggctactgaatcacacaatggaaaactacaaacaggagtaggcttgtgcagcattagattagtttttaacgtgaatcaaagtatgtttcctataatttaagtaaaagcctgatatggttagactaggacaaggacttaaatcatagctttcaaagcaagacagacaggtggtaggaggaaaatatttcaatggtttatagcaaaaagaaattactactaggttaaaagaaaaacttataaatttacaccaaaagatgtaatctgtggtttttaatgctaccagaggagaaactgtgtggttattagacatctgcctttgttttgccaaatattattttttgccaaatattatttgccaaaataatatgacagacataagcagttttcttaagcttcagaattttgtaatgtgaggtttaaattgttatatattcagattaaattaattaaggcttacaattaacttctaatacatttacactatgtaaataaaaatatatgtagaaacagcaaaagagtattattatctctggggcttaagaaaagatcttaccagagtgatttcatgaaataagataatcttacagattttcccatctcttgaaaatgccaagatagttttgtgtaactcatgttgcttttggaaatggactcagaattatttagtgtattacatctgcatactatccggagtaaactttagctattttaagatctaattcccagaactcccctacaactcacagctgataatttaagaaaactaaacacaggagagaagaatttgtttttcctaacactttaattacaatgcagaaaaaaaaaggagggccctggttaaagccaactgtttcctcagaaagctgataagccagaagagacaggatatgaaaaaagagagacaacacaaaagaccagtgaagatcagcaggtgatacagagcagtgctatcgacgggaccataacaatgtcacaaaggaccaaaaaatagcagtcgtgatagctctgcaataaatgttggtgaatgtagggtggatggcaaactacagatacctgcagagtatagtctgaagacactggccatttcctctgcatagctgggtgacaggaaccagggctgctacctgagtccatcctgtaaccaccaaaagcatctgtgtctctttaaaaaaggacagcccgaggagttcatcacccatcttaacacactagtgtaaaaagactgtataaaaggtttgtacatctatggtggaacagggctatggactctgcagaaatcatctgacaacctgctcaccaacctcttcatgggaagagcacgctgagaagcataaggaagtgaggatgaagtaaactgttgttctggattctaagtcatctgacactacaactcaaaaacaaatgtttcaaattaaagcatctggatcttttccttaagaacaactctcagagaagatctaacaccttccccatgttaaagatacagggacaggaatggggactgtcacaaaggtttcatctgcacagcaaacagaaccagcataagaaatccacactgaataaatgaaaagtaccaaatcaaggcctttgtatttttgtcagaacatatttgattacaatctccctcccgaatggcttccagtggtgataaaatgactatttttcttaatgctttccaactttcaccgtagcaaggagccgcatcccccaggtttaagctgagtacagacattttgataattcttgcaggtgatgtttcaagtgttcattgaaatcttctaattgaaatttttctttttaaagagccaggcataacacatagtggcctgcagtgaacttgtaagtaactaacctcccctatatttttccctcgcaccaccaccaagttggggcttatccaataaatatctgctcagccacttttctgacttgaaatccagggctttattcttactcctatttatccaatttcatctagttgggtttggtctggcattagttctgactggaccagaccaatctagtccctgagagaagtcatttctcaacactaattctcttttggactaactcattctgaattgaaaaacagttgaggaaatgaaaaaacaatgcaggcctttccagtctactaaaaaaccaaacttttttgtctgttggaagagatggaagaatgagttagctgctgagcctgttttaagtttctcatactgatctggttaagtttgtttttttaaaagccaacacaatttctcacatatgactaagggaatttaatatttaaagatatatttgttaaaataataatgcacattattgaataatccctaacatattaagtatttactacaagacacacagtgtgcttacctttttaatgcattacctcagatactcatcacatccatcccgtgagggagacaatgttaccatacatattttaccaatgagaaaacaaaggcttagagaagttacgtaacttgacaatatgcaaagttttgttggttttcattaagaaaaatgcttccaacatctttgtgatcgtttaataaaataaggggtaaattacctccatatttaaattggaattggagaagactattttctggtgacttcaaaagcatctgcttcaggtaatgtttcctgattttattacattatcacaattatattatggccactgcaaaagttgaacaatgcattaaaatgaataatttcttaaaaatacacaagacctaaacagatacctagtattctgattactatgcattaggataatctaaaataaaggcacccctttaataagaaaattacaagtaaattcctttctgttaggaattcacttcattctggttcaaacctcattctgattctttgttcaatcaaaattgaaccattaattactcatctggtttgtaaagcaacttcactactggtatgctgccaaattttgtaagatagctgtttattacttttctttaggttttcatacacaaacacacacacacacacaaacacacacacaaacacgagagacagagtcttgctctgttgcccaagctggagtgcagtggtacaatcatggctcactgcagcctagacctcctgggctcaagtgatcctcctacctcagcctccccagtagctaggactacaggcacatgccaccacacagggttaatttttgtatttttttgtagagatgggttttgccatgttgcccaggctggtcttgaacttctgggctccagtgatccttccgccgatgtgctgggattacaggcatgagccactgcccccagcctaggttttcttttagatagaaccaaaatatggtcctttcaaagtctgtgtgaattatgaatcagaataaaatgaaaaagaaaatttaataccctattcaataaatataattaaaaagtattatcctgtgtattttgaatctctgaaataactatagaatccaaagaaatagtgaaaaatttaaacagtactcagagctttatcctaaagtcagataattagtaggaagcatagctgataaactgtacaaggtcagtgaagagccttccagttggtgtgaagtccagcctagctcttcagctattactcagagtgggacactcatctggatgaagaaagccagtggcacaccctgattcacttaaaaatatatactacttttatgtgtaaaagtgcatgaagagtgaaatactactgattaagtggcacacacagattttattttcacttaagaagtattaatgaaagcccatgaatgtaacacaatacattcctaaacacctggatttcctggagactgactatatcaccatattcacttgtctgcttccctgttcttaccaggtcctctcatctaagatgaacttcaactatagagtcaagcccagcaacagtaagaataaggctgggaagctaagcaagagccagagcattgttggtttcttcctactttggagattttgtgttttaaattaactttaaaagaacagggaacacaacaaaatctagagaaatgcactgaaaaatctagagaaatgtgttagaaatgcactttaaaaagagggctcactgaaactaatgaaaagcaaggccggggtgcttgtctcttctaggggagtcaggaaaggcttcacaaaagtgaccccagttttagaacgagaggtacagagacaaattcaaaagtttctgcagaatatagaaggctgcagttgatcttcccacgggaggcagacaggcaatcctcctcccagagcaagctacaaggacgtgcaaattgtgcactcacaggggtcacacggtgcactcatagggccccgtattcagaaggaagggcctggcacttgctttaacgctatgcctgcgctagcgttatcctctttctctgctgacatccagtcagaggcctactaactcttccttctaaatgttctgctaactgtcctcttctccacttaaactacttatcgactccaacttaagcagcagcctcctaatgggccttgtgtttaccctcaaactattttataagatgactggtctttctaaatggcatgtctgatcctgcataaaatcatttccctttgtaattgataatccaatgatgtcagcattagtaaataatgactgacttcagcaaggcatagtgggtgtattattttgttggctcaacacctgtacttcaggcacgccattccgcttcttctggtaacccaacccaaccctctacgagaatgtccttcccatgcaagctggcacctgaacctagctgggcaaatcagagcctttccctggcattttgttagaatggaggaggctgcaagatgtcaaaactcagaagctgtcagcatccatgattcctgccaagtgtggaaagctgtcaatacccagacagaaataagaaatggagagtcctagcagtttgggttcctggttctagcctcttgagacccagctggcatctataattttctgtttaactctggtttttctgagacaataaattcctctttttgcttaagttaataaagctaggtttcttgctggtacacataatatggcaattcattatttggttcctacttctccacctaacctatctcctccccttgtaagctctcacacacactttacaatagaacgcttaatattccacgaattcaacatgctatcacacctctgcacctcagtctctgcacctctggttccaacactggggtcacctttgtgaagtcttcactgacttccctaaaagagacaagcaccccgccttgctttccactagtctgtgcctaagtgcaagctcttaccgcaaagtactgcaactgcccatgtggatgactgactagagcctagaagagcagttaagaacttggactctggagccaaattgagcagctccccactgagtggctatgacctctctgccagttgggcaggcctctccgtaactcaatttctcgtccataaagagagagacaaataacgcctactccagaagattgttgtgaacacagaaccaaaacgtggacctttcaaagtccctatgaatcataaatcataataaaaaaaagaaaactgaattgaaaaggtttactgttttctctggagctcgtaatcacaattactctgcacttcagaaaagccaccctcaacatttgttttctaggaaatgtcaataagcaggtggaaataaaatgctccgaagaacaaacccgtacgaagagacctactgccaaatctgctagtgagtgccggcaatccaccacttccagactgagacctaagacggactgccacttacttctcagctgccacttacttctcagctggcgacataatgcatactttcctaccctaagcactttgagtccccccccccacccccgctaagaaagaagtatttaagccacgaactgagaccacgatgccacatgctgatcaggacactcacagtcatgcgtcacttaacgatggagatccgttctgagaaatggagaaatgtccccttaggcaatttcttcgggcagtagaaacccagacaaacccagatgacacagcctactgctcttaggtcatgaacctgtacagcctgtcactgcactgaacactgcaggcaaccgtagcatactagtgagtatctgcgtatctaaccataaaaaaaggtacagtaagaagacgatattataatctttgagaccacgctgtcccacattgaccagcaacgtccttctgcagcgcataatcgtatttaaaagtggattacaagagtcggaaaaacaagcggcgtgatttgttgtggcggcaaccagggaagaggcaggagaaaggcaaccgacgagttcaaaccacggagccccagtctcgcgaccccacctcgcgtccccgtcgcccgctcagggcccgacgcaggggtcccgggctagggcgacctcggagaagcggggcggggcttcccggctggggcggatccctccctccctctcgtcccgacccggccgcagccctgccgcgaacgacggtacctgaggacggccccagatccgcggtgcccatctcagccctgctcacaccctgcatgacaaggggtaggagaaagaggagagccatgctgctaccgacggtcgctggctccaaccccgagcgcctgcgggaccagcccagcactgccctccagccccggccttacgtcacttccgtcaccggggtctgt

SEQ ID NO: 1765 - DNA, 34627 bp, Homo sapiens
  source 1..34627: mol_type = genomic DNA
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaaagcccgggggtctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgctgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccaggtgagccgggcctgggcctccgcggcgggacgcgggcgcagccgcagcatgtgggggctgggggactcccggatcgtggggtggggggaatctgccgggtgctcagagtgggtgggaatctgcggggtgctcctggtgggtgggatatgcggagtgctcagatcaggtgggaacctgcgggtgccccaggtgggggtcttgcggggtgcccagggctagaggggcccgctgggagcccgcagcggggctgggatgggcggccaggagttccagacaggagctgggcagcagcaggaagacggggggcacccctcctggcgtcctggccgccgggacacccctctccgggagaggacactcggtgcccctccgtgaagccggtaacctcggctgcgccacctcccccacccgcgcgcccgcgccgggaaagccagcgtggccccagtctccgaatttctcggaatgaacaacagcaaattgaatccagggctccggcgggggccgcctttgctggccactggttctgcagcctggcgagactgcgcttagtccccgcctggagtgcctcccgaaggcctggctggaagctagactcagtccctttgtagtagcagcggtggagcagggaccagcgtcttggacgggtgacccagactcaattccgactttggccgagggcatgtttgacactgggtgtgaaatctagacagttcccgcggtcatagagatggggcagcagcattcaggcagggctcagaactgtccgggtcccatcagtgttggggcggaagaggaagagtgtcaactgagccaggcatttatttattttattgttgtttgagacagggtgtcgctctgtcgcccaggctggagtgcagtgggcagcatctcagctactgcagcctccgcctcccgtgctcaagcgatcctcccacgtcagcctcccaagaaggtggtattattggccacgcctggccaatttttgtattttttgtagagaggaggtctcactgtgttgcccaggctgttcttgtactcctgagctccagcaatccacccgccttggcctctgaaagcgctgggattacaggcttgaggcaccgtgcccagctgagccaggcttttaaaaccggttctgtccctacccagagagcttcttacctggcggcctccttaacctctgacaccagctgaccacgcttatgagccaaacataaaaaccaaaagaaacccaggcttggtggctcacgcctgtaatcccagcactttgggaggctgaggcagcatcatgaggtcaggagttcgagaccagcttgaccaacatggtgaaacccccgtctgtgctaaaaatacatagctgggcgtggtagcgcccgcctgtaatcccaactactcaggaggccgaggcgggagaatcacttgaacccgagagctgagatctcaccactgcactcccgcctgggcgacagagcaagactctgtctcagaaaaaaaaaaaaaaaaaaaagaaaaagaggaaaagaccttaatgacaaatgtgtggctagaacattcttgtgtatgtatctgcttttgttttgctgggttctttcccctggggagagtgatatcataggagtctcgagaatttagaagattcttcccattcgaagctataaccttgtgttgtgggtttgttttttctaccggcattccttgcaaaggcccataagttccgtatctccttgatctggggtgccttgcacttgaggaaattattaactgcttttccatgggagtcagacagatgggttcaaatcctgactctgcttccacttggcttcacgtcttgagcaatctgcatatgcctcctccctaggcctcctcctaatgagagttgatgattgtcctagtgtgggatcagcaggcgagtgacttcatgccagagaggagtgactagtggtgatctgtggactgtttgtgacttacctgtgatgagtccagaggttgaaagatgtatttagaaactatagtctgacattgccacaacatccagctacctgtccatcttgttaatgattaactttaattgtattctacaaaagttttggtctatgtgatatgttgcaaaataaaaaaattttaaaaagtgaggccaggctcggtggctcacacctgtaatcccagcactttgggaggctgaggcgggcggatcacctgaggtcaggagttcaagaccaggctggtcaacaatgatgaaaccccgtctctaccaaaaatacaaaaattagggggcgtgatggtacacacctgtgtcccagctactcaggaggctgaagccgaagaatcacttaaactcaggaggcagaggtgcagtaagctgagatcacaccactgcactccagcctgggcgacaagagcaagactctatctcaaaaaaacaaaaacaaacaaataaaaaaactggctccattgatcctttgaaaagtagtagcagctgggcacggtggctcatgcctgtaatcccattactttgggaggcagaggtgagcagatcacctgaggtcagaagttccagagaccagtgtggccaacatgttaaaaaccccttctttactaaaactacgaaaattacccgggcgtggtggttggcgcctgtaatcccagctacctgggaggctgaggcaggagaatcacttgaacctgggaggggaggttgcagtgagccgaaatcatgcaactgcactccagcctgggtgacagagcaagactctgtctcaaaaaaagaaaaaaaaagaaaagaaaagtagtgtagtgctttaaactaatctctattttgcaactatttgaacattttcacattaaacagcttaaaaacaaacctaatggatatcttcaaaagaaacactcttttagtcaaaacacaaagtgaaaatattcacaatgattatatggcaaatgggtggtagaaaggttttcacactttcccataacttaccggtgtaattttgaaattgcttttatggtcagagaaaaaaaaaagtgttggaaactttttttttttttttttgagatagtatctctctccatcgcccaggctgcagtgcagtggcatgatcacagctcactgcagtctcaacctcttgggctcaagccatccacccacctcagcctcctgagtagctgggactacacgtgcacgccatcatacctggctaatttttgtatttttttgtagagatgaggtttcaccgtgtttcccaggctggttttgaactcctggggtcaagagatccacccgcctcagcctcccaaagtgctaggattatagatgtgaaccacccagcctggctccggaaacagattttttaaagggagacatagtatctatcccttagagttctgtaagagtagaatatgtaaaatatgggacctgtggcaatttgtagccatgagctgttaagtagtggccgtttgcgctagatagaaaaatgtaaccaacagcacaagtgcagtaaatcaactgaccagttagttacctgagtgttgaggaattaaggcttctatttgtaattgtagcaggtgctgctgactttttcaggggattggatatgtactgtgccacagaattttttatcattatttgctgacttgaacagccagagcttctcatatgcttagagaccaccgagaaagacagtaagtccccagcaacttaaaaaccattgcatgtgaatgtccactgggtaagctcctgagtgttcataatctcagcaagtgaaaatatcatgtagctggaatgcttttgccacctttataaacgatcatgatagtaacatttattggtcagacgagatgccaagtgctttatatacattacctctcttaattttctcagccattctttcgaactaggttatatctctagtttacttcctggaaagtcaaacctttcttgataggaagagccaaataatctaggtcaataacttgatgtccagttgttgttgttgtttttgagacggagtctcgccctgatgcccaggtgggaatgcagtggcgctatctcggctcactgcaacctctatctcccaggttcaagcgattctcctgtctcagcctcccaagtagctgggactataggcacctgccaccatgctttgctaatttttatatttttagtagggacggggtttcaccacgttggctaggctggtctcgaactcctgacctcaagtgatccccaccgcacccccccccgccaacccccgccagcctcagcctcccaaagtgttgggattacaggcatgagctaccatgcctggcctagtatttcttgaagagaacaatttcctggttatggctgaggaatcagaaaatgcctttttatttctcatctgcaaggtgatggaggtgggatcaatgatgttcacctaattgactttcatcataatgtccccgcccccaatagaaagatcctaaagggtcagtccttaattatcaagattaaatgattaatgttaattatattttattttattatctgtgtgtgataagtgttaatcaaactatgctgttaagacccaggatatcctcctattctttttgtttgtttgtttgatatggagttttgctcttgttgcccagctggagtgcagtggcatggtcttgactcactgcaacctccacctcccgggttcaagtgattctcctgcctcagcctcccaagtaactgtgattacagtatgcaccaccgcacctggctaatttttgtatttttagtagagacagggtttcaccacgttggtcaggctggtctcgaactcctgaccttaagtgatctgcctgcctcaacctcccaaagtgctgggattacaggcatgagccaccgcacccagcccctcctattcctaaatatgcataaagtctgaaatgcctggatctgggataggtagatcaaaggtgttgggatgggtcaggaaggcagagttgttcattcacctcttcactggttgttaaatggtcctagtgtttggccctgagtgtataaaaatgattaagacaatgaatgtagagaatagtctacttagagaccttgtcagaatgtctgtattaccatgtgtactataatagatacacatacactatgtgccatgatttttcaaaagtgctagaatagaaatatttttaaatgttataggacactacttgccaggaagagttgaagaaagtccaatagaggaagaacaaactgagctgggttttgaagcatggagtttcagattaaagaaaagaagaaaaggccaggtgtggtggctcacgcctgtaatcccagcactttgggaggccgaggcaggtggatcactaggtcaggagttcgagaccagcctggccaagatggtgaaacgctgtctctactaaaaatacaaaaattagctgggcacagtggcgggtgcctgtaatcccagctactcaggaggctgaggcaggagaatcgcttgaacccaggaagtggaggttacagtgagcctagatcgtgccactacactctagcctgggtgacagaacaagactgtctcaaaaaaaaaagaggccgggctcagtggctcacacctgtaatcccagcactgtgggaggccaaggcaggcagatcaggaggtcaggagatcaagaccatcctggctaataatggtgaaacctcgtctctcctaaaagcacaaaaaaatagccaggcgtggtagcaggtgcctgtaatcccagctactcgggaggctgaggcaggagaattgcttgaacctgggaggtggaggttgcagtaagccgagatcacgccactgcgacactgcactccagcctgggggacagagtgagactctgtctcaaaagaaaaaaagaaaaagcaatatgcaaaattatgtaggtccaaaataaaataggatagagtttatggtattttagcgagtggtggtgattggtctgggataagatcttgaaggattttcagcttactcaagtctgaactctaccctccatgccaggaatcggcaaagtttttctgtaaagaactagacagtatgcactcagatggttacagaagtttgattaaatggctgatttctgaattaggtatggcgcttgagactctgcctagggagagtgctcaggtcatgcttatatgtgaaaatgtgtcgttattttttcctcttgctctcacacatgtcccttggtttcctaagtgaggttttgaaaatgaaattttgacagttgagccaaaatgccctctataagcacgtgtatttccttctttaaagaattccctctcaggaattccctctctaatgtattgtaagatttggggttcgaccattaacgcattagtccagttcaataagcttcatttttttttgttggtagcagggtccattttatgggcgaacataccagtaagttccttgccttcggggaagtttaagtttattaaaagcagttacagatatattacagatgtattatacaggaggttctcaagaggcaagaaggttcagcaagttcattgtcttaattacaataattttttttttttttttttgagacagagtctctctctgtcacccaagctggagtgcagtggtgcaatctcggctcactgcagcctccacctcccaggttcaagtaaattctctggctcagcctcccaagtagcttgaattacaggcacccaccaccatgcctggctaatttttatatttttagtaaagatggggtttcaccatcttggccaggctggtcttgaactcctgacctcatgatccacccaccttggcctcccaaagtgctgagattacaggcgtgagccactgcggccagcctacaacaatttttttttttttgagacagagtctcgctcttgtcgcccaagctggagtgcagtggcgtgatctcagctcattgcaacctccactgccgggttcaaatgattcttgtgcttcagcctcccaagtagctggaaatgcaggtgtgcaccactatgcctggctaattgttgtatttttagtagagacggggtttcaccatgttggccaggctggtttcaaactcccaaactcaggtgatccgcccacctcagcctccctaagtgctgggattacaggcgtgagccaccacgcccatccaattagaataactttttacatgttgtatttttaaaattcataactcataatctaaaatttatgctcagcacagctaactttggagacctaccaagaatggtgcaatgattcagcagctactcatggtaagacaagagtatctgggtgtaacctgtatgaaacctgcatctcacaaccactgctccttctccccagccttccagccctggtgtttcccatcgggggccatgtggcctggaacacagaggctgggctgcccaaggacaggccccctggcctacaaaaaggacagtcttatcacagatgtgcaatccttggcacttccctgtggcgtctgcagttctgagactgattttcttctataaatgtgaaaagataggggatgataggaaacccggatataaggcagaacaatgttgcttgggccatctcttacacctcagtgaaacggaaaatgaaggaaatggaaggctggcatgggaaccccgacttatacagtgatgcccttttgctgttccacgcgtcgcttggggtggaagcccttccttgtcccctcgccacccaccccggagccccttggtgcttcctttctgaactgaatgcttagactggggaactagaggtgcccggaaagggaagtcgggaagaagagactattcctgttggttcctccccagagatgggagatggtgaacaggcgtgtggagggcggaataatggtccccaaagatgtccacgccctcatcctcagagtccgtgaacctgggaatgtgctgcctgacgtacaaaagggactccgcagatgtgagtaagttaagagccctgatgtggggagattgtcttgcattgttgggccaagtggccttataccaccacagggtccccaaaagatggagcagaggcagaaggttcagtaccagggagacaagaaggatgcggccaaccttgctggaggaaggtgccctgagccaaagaatgggagtggcctctagaagctgggaaaggcaaggaaatggattctccctggaggctcgagaaggaccccagccctgctgataacttgactttagtcagtgagactgactttaaacttctgaccagcagaactataagaaaataaatttagatgtgattttttaaaatttatttatttttagagatggggggatctcgctatgttggccaggctagagtgcaatgattattcacaggcatgatcatagcacatgcactacagcctcgaactcctgggctccagtgatcctcccgcctcagccccttgagcagctgggactacaggtgcgcaccaccacgcccagctaaatctgggttgtgtggagtcactaggttagtgataatgtgttacagtgataagaagaacctaatacaggaaataaaaggagttgtcagattctttgaatgcccaaccctaagcagacactcaccctgttcctggaaagagccgggtccagctgcgttttctcatggcccaataacaagaagcagacaaactaggaagaaagagaatttattgctgtaacaggaaggtcggagataatccgaccagaccaactcaaagtgtttgattttctttgtgcttacataggtttgggttatgtgcctatgtgtggtattgcactaagtctatgagtaactaattttgtttcaactagaaagtcagaggccaaaaatgtgctttctaagtctaatcaagctgtgaggtccccgataccgtcaaggcctgtctcctaaattctatttaatgaggactgtggtaccagagcatttatttatttatttatttttgagacggagtgccgctctgtcgcccaggctggagcgcagtggtgcaatcttggcttgctgcaacctccgcctcccgggttcaagcgattctcctgcctcagcctcccaggtcgctgggactacaggtgtgtgccaccatgcctggctaatttttctatttttagtagagacagggtttcaccatgttggccaggctggcctcgaactcctgacctcaggtgatccaccacctcagcgtcccaaagtgctgggatttcaggcatgagccactgtgcccggccaggagtttatttctatcttgtctcatttacagtttggtccggagagctgccttagactctccaataaatctattcaaacagctgcctctgttatcttgacttgctccaggtttggaagaagcctgtgtaggatctgtgtttcatttctggctttgatgtctgggcgtcagtttccctggggttaattattagcttaatgtgaaggcagcattgtggaaatttctctgcatagttcggatgctattcagatctgtctgtgtgactgtcatgcaggcctctctgtgtgactgtgagggagcattgacctgccaccacccccctctggaagcatccagtccccaactggctttgggcattgctaggtcatagcagccacagcacacctggtgggcctgcctcttgccacgcagctttacctgtctgccttcggcccaggatgtcatgaggcctgctgtgtgtcaggagaagtgttgttagctggttgggtgaaggtcacccagagctcataggtgtggaggggaggggcatcctataactaaacaaatggccgcagacttggcaattcatctttcagaagaagagccagtggtcaggctgtcagctgatctctttgaggttgagcgcatttaccgaaaatgtgtggcttgaatttcctgctttgaattttggaacagcatgtttttcaaacctttcttccaccttctgggcatttcttattaatctttttggtcaaaagccttatcttgattatgttttctttctaagacaaagggctccctgtgaagtacctgcttgggaaagggaggagttgtggcagtttcttctaggtccccgaaggctccctgtgaagtacctgcttggggaagggagaggttgtggttgtttcttccaggtcaccccaaagagagggattctgatattggtggtgtttccgggggagtatattctttctctgtttattgccccctaacctttttttttttttttttttttttggagacagagtctctctctgtcgcccagactggagtgcaatggtgcgatctcagctccctgcaacctctgcctcctgggttcaagcgattctcctgcctcagcctcctgagtagctgggattacaggcgctcaccaccgcacctggctaacttttatatttttagtagagacagagttttgccatgttggccacactggtctcaaactcctgacctcgagtgatctgccttccttggcctcccacagtgctgggattataggtgtgagccactgagctcgggccgtgttgtcctctaactttaatgtgtgtgagaagcagctggaaagcttgtttaaaatgcagatttcctgggggcctcaggacctgcactttaaccagcacccctgtgattgcgatgctgggggtccttgagagacgacaactctgatggtgcccagaagtcggcgttccttgccctcccctgcagcttgggctttgcgtacctgatttaggatgtttgtgtgtttttgcgtgtgtagtgtgtgcacgtgtgcacgtatttgcggacatttaccagacacttccttggtactaaatctgaaagctaacgcgtgtcacatgatcaccacgttaatcttcgccacagccctgtgggtgtatcattattgaccccttattcctgaaaaagaaaactcaagctcagacaggtgaagtgacctgccccgagcctaatgcagttactaatggtagaactgggaccccagtccggccagactccagggcccaggacctgttcgtaacaactgggacctgcaggtggaaaggctgccccaggcgcctcttttctttttgtgctgcctgtaccagtagggccatctttgtagccaaaagtcgggggtgtggggccatgcccagggggacctggtaatgccatttctgcactttgacaaaaactgagttgtatgaatgacttagataatggacattgaaacatttttgtaattatttccctctctctcctcccttcctccctcttctttttctctgtccccctcaagaccctctttcccagctgcccgctcctcagcacccgaagattcgcctgtacaacgcagagcaggtcctgagttgggagccagtggccctgagcaatagcacgaggcctgttgtctaccaagtgcagtttaaatagtaagccggtatttctgttggatccttgctgggagctgtgggggcatcgtgcggaaccctggggccacatactagtccctgcctctgtgcagggtttgttatcaaacccgtgggaaacacatcgttcttggagcttgtaaaatctctgaggacagaggtttcacagcctcccactcatctgaaggcttaaactacactggcagtcaggactccgctgtctaaccacacgggttcttgctttggtggaaagttcattctttcgctggtttcaggagaaaggttgtaaaaataggcttccaccatggaagaacaggaggcagcttttagtcttcatcttcgggcttaaaaatcggattgatttaaccttatagaccaaatatggcctgatcagaaatttgtttggttaattacaatgaattctgagtttctcaactggttttccattttgcatattatcctggctctttcatctgtctcttgcctcttcaagcttttgcagaattggccatcacttgatttgcaatataaatacatatagaaagagggcaaagtccacatcctttgttattttttgtttacgttgttaagtaggttaattgaagagtaaggtgaagttattggctaagtcattttgtactatttggtaaaccaaatgtaaagacatgatgatgtccagtgcttgtgagatgggactggttcatatgtgttcacctgatgctgtttgcagaatcaattagcatagccctttcaaagaggaattctaccagacatttgaagtcatggaaatgtccatagtagttttccaatgtgtgtgtgtgtgtgcacgtgtgcatgtgtgtctgtttgttgttgttgttttgaaacagagtttccctctatcgcccaggctggagggcaatggcatgatctcagctcactgcaacttccacctcctgggttcaagtgattctcatgcctcctgagtagctgggactacaggcatgagctaccatggctggctaataggtatatttttagtagagatggggttttgccatgttggccaggctggtctcaaattcctggccccatcctcaagtgatttgcccgcctgggcctcccaaagtgctgggattgcaggcatgagccaccgtgcccagccttcatagtagttttatcctacacagataattcaaccccccatcaaaaaaaagagagacaaaaactataatcatgaagagatacatggaagtgtatattcatatccatcagtaggaaagtgaccaattttagcctgctaacttacgcttgaacactaaaccacagacagccaatagaaaggataattagatgtcatctggtagaaattgcaactctgtaaactttggcatgtatttgtattttttatttcttatttttgttacttaaaaaaattttttattcacttttatactgaaaagttgcaagtggtatgtatttattgtcaagaatagaaaggggccgatcatggtggctcacacctgtaaaagaatagaaaagtaggccaggcatggtggctcacgcctgtaatcccagcactttgggaggccaagacgggcggatcacgcggtgaggagatcgagaccatcctggctaacacgctgaaaccctgtctctactaaaaatacaaaaaattagctgggtgtagtggcgggcgcctgtagtcccagctacttgggaggctgaggcaggagaatggcgtgaacccgggaggcagagcttgcagtgaaccgagatcgtgccactgcactccaggctgggcgacagagcgagactccatctcaaaaaaaaaaaaaaaagaatagaaaagtaatgtggaaaaatgacaggcaattgatttgttagaggagtaggtttccaggtaacttgtttttctttttctttttctttttttttttttttttgagacaaagtctccgtcacccaggctgaaatgcagtggcacgatcttggctcactggacctccgcctcccaggttcaagcaattcttatacctcagccttctgtgtagctgggattacaagtgtgcaccaccccacccggttcagataacttcttttttttttttctgagacaaggtctcactctgccccccaggctggagtgcagtggcatgatcatggctcaatgcagccacaatttcctggctcaagagatcctcctacttcagcctcccaagtagctgggactatgggcgcacactgctgtacccagctaatttttaattttttgaagagatggggttttgccatgttgcccaggctggcctcgaactcctgggctcaagtgatccacccacctcaacctcccaaagtgctgggattacagacatgagccatcacactggcgtttcttatttgtttttaaatgtccgttgtaacagtatttgcttaatagaaacaggtgctaaactgaggtttgagagttatctctaaatcacattgatctgttcctccagtagttataaattacgaacattaagttacctgtaattaatggagcaatccaccagagcaggctacacaatttgcaagacccagtgcaaaatgaaaatgtgagaccctttatttaaaaagtattaagaatttcaagatggcaaccgcagagcatcaaatgaagtgcctttctgagaacgggcttgatgtgagcgcacaggtcacatgtcaggaagttggccctaccctcagcattcagcaaacattacaccctagagctaaacaagaagcttgttgtgagagtcacggctgatgtattgacttaggcttgatgctgatttatgggctccttggccttgaacaaggaagtacgtttactgattttcagaggagatgcttctaaaaatgggataaaacgttattgcattaaaaaaaaaaacctttgatagagtttcatttgataaactaacctgtttcactttgtcttcttttcaaaaagcattttatagatattttctcagggataaaggttggttttattttttatttatttatttatttattttgagacagagtctcgctctgtcatccaggctggagtgcagtggcgtgatctcagctgactgcaactttcggctcattgcaacctgcggctcactgcagcctccgcctcgtgggttcaagcgattctcctgcctcagactcctgagtagctgggattacaggcacccaccactacgcccggctgatttttatatttttagtagagacagcttttcaccatgttggccaggctggtctcgaactcctgacctcaggtgatccgcccacctagcctcccaaagtgctggaattataggtgtaagccatcacgcccagcctagaggttggttttagtaaaagaaacataggttagggtacatgtgaatattcctgttagaaaaaggtgaaatcggggatgatttctttttctttttcagtttgtagatttgataatggaagagggcctttgcatttgtttttagatactttgttttagatacaaacatgtgtttgggactttttattagttttgaggcttgtgagacttaaatttccaccgtgtttctctacaataaagcattgctatgattaaaaatgaagatgcctttgttttttgacagagtatcaagaccaaaattacatggagcacttgatgggagaatttcaagtctaaatcatgggtagcagacagtggctgcaggctatttggctcccagtgtttaattttttttttcttcaatttgttgccaacattaagaaatctggacttttcacttagaaaaaaataataataaataacaggaaaaaaaaccaatcctgatgtcagttttccttgaaaatgcagacagtcgggcagcaaggccccttccagatcacgcctcctggtctactgccagcccctctctcagacctgcccagccctgtcttctcaaacatttgtttttcattttcttctgattttaatagcaatccatgttctttatagaaaatctggacaatctagaaaagtagaagaaaataaaataacctgttgttctacactctaagaataatcactattctcattttattttactttttattttatcttatttatttatttatttgagacagagtcttactctgttgcccaggctggactgcagtggcgtgatctcagctcactgaaacctccgccgcctgggttcaagtgattgtcctgcctcagccttccaagtagctgggattacaggcgcccgccaccatgcctggctaatttttttgtatttttagtagagatgcagtttcaccatgttagctaggctggtttcgaactcctcacctgaagtgatctgcccgcctcagcctcccaaagtgctgggattacaggtgtgagccactgcacccagccattattctcattttagacttttttttctaaattcgttctcttgtttgaaaattgtgtgtgtgtgtgtgtgtgtgtaaaccaaaccagactggggtcacacttctggggtctatttccttttttattttaacttgatgtagttaaatgtgagcattttttcatgtaattatttctgtgtggacattgtatgtttcattatgtgacatatcacatgtgttgtatttaacttttccccagtcatgggcgtagacagttggcagcttgtgcctgtcctaagtcatgacctcgtacatgaatcatatctggttattttcttacacttctagaagagaggttgctgggtcaaaggggatggacttacttaatgtttttgtgagtgacctcacaaaggctggacatagctcttgagtcccagggacaggctgagccccggcagtggcaggggtttgggggagcaggccctgcactgcatttgaggaagagccgtgcatgttgctcttggaggaggaggagcggggcggttagagggtctttaggtatctgtctaccttgaaaaagaaatcactcacctcttccagagcacgcccctcacccccgacctgagaggagaggctcgtggtttgcgatccctctccccattagggtctgtcaccctggggctgagtagtaggtatctatggcgggtgtcttcatggaagccctggccacgcatcttgaagtggctttcatcttgtcccttgcaacttaagcggaagatgcatcttggagagggtcggaggtacagttagaagcatgtgtggtacgtgaaagccggtggtcgtggggatacagagcggtctccagtctcgtctcctgtctcccatggccttgctttctgggccatagttgctgttgtagggggatactgtccgctgcccctactcaggctcccagcagccacctccttggcctttctgaagtctgtcacctaaggcaaagaggtcagagctggggactagagtcccacgtgggagtgtggcattgggactctgggaaaggcactgtcattcacaaggatgtgtggccatgtatttggcaaggttttcatatgggtgagacaaatcctctttgaatgggcagctatgggtggaaagaaactccgcaccagcaggaagcaggactggagtttgtattaacacagttccattcccaaaacataggctacagagactgagtttgaagtattaaaatcagttatgggatggaatgggagaaaatatttgcaaatcatctatctgacaagggacttgtatccagaatagataacgaactcttacaattcaacaattagaagacaaataacccaattaaaaaccacagctgggcacaagggatcacacctgtaatcccagcactttgggaggccaaggcaggaggattacttgagtctaggagttcaagaccagcctgggcaacaaggagagacccccaactctacaaagaaattaaaaataaaaataacagtagcagccaagcacagtggctcacgcttgtaatttcagcactttgggaggccgaggtgggcggatcacatgaggccaggagtttgagaccagcctgaccaacatagtaaaaccccgtttctactaaaaatataaaaattaaccaggcatgatggtgcatgcctgtaatcccagcacattgggaggccaaggcaggtggatcacttgaggtcaggagtttgagaccagcctggccaacatggtgacaccccatctctactaaaaatacaaaaattacctgggtgtggtggctcacacctgtagttccagctactcgggaggctgaggcacaagaatcacttgaacccaggaggtggaggttgctgtgagccaagattgcgctactgcactccagcctgggtgacagagcaaaactccatctcaaaaaaaaaaaaaaaaaaagcgggggggaactgtatggtacatataaattgtatctcaataaacctgcgttttgaacaaaagctctggggaaactattacacatgaaacagagaattctgtgaattgaaatccttttttccttcccagcaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatggtaagagaacttgagtatagaacttcctttatactttccaggttttcttcacttgcggtatcgactccacacacctctgtcctgcctgtcaccctaaatgaccagcagacaaatgggtaggacagtcaaacccacactctgaccttggaggctgatgctaagggagtgtgatttgctaaaccaggggttggccaactacagcctgcaggccaaatcgggcccaccacttgtttttgtaaataaagttttattggaacacacagttacatccatcttttattgtgtctatgactgctttcacactacaatggtagagtagttgcaatagcagctgttgagcctgcaaagtctaaatttactgtggctctttactgaaaaagtttgccaacctcatgctagaagggatgctagcatatctctctgatcacccttacttattctggtgcaacttcttttgtgttgcagaataggcaccttgaatggtgcctggcatgtagtaggtattcagtaaatatttgttgaatgactgagtgaacaaatatgtccccagatattggaaggagacagaagaaccctcagattccagttcctacatttgttcctccagtaattcatttgtcacgtagtcagccatgccagatgtttcttccgtgtctggtttatgcacacacagggcatgaaacttacatggatcttgatttagacaaactaatgtataagacaattgaaatgtgatcaccgtctagatatttgatatataatgaacaattttattgttgacttattttcagtgttataatggtgttttggttatgatttttaaaggaggaggaggtctggttaagatgttaaagtttatgttatgtgtattttaccacaataaaaaattgggggaataaaaagagttcctgctgggcgcggtggctcacgcctataatcccagcactttgggaggccgaggcaggcagatcacttgaggtcaggagttcgagaccagcctggccaacatggtgaaaccccatctctactaaaaacacaaaaattagctggatgtggtggtgcatacctgtaatcccagctacttgggaagctgaggtaggagaatcgcttgaaccggggaggcagaggttgtggtgagctgagattgcaccattgcactccagcctgggcaacaagagtgaaactccatctcaaaaaaaaaaaaaaaaaaaaaaaaagcaaaataatccaaagaacaggagggacaaggacaaagcttccaggcatagaagaaacaaaattggccataagttgacagttgattcagttgggtaattagtacatgagtgtttgttaatgatcttccctctactttttttttttttttttttttgagacggagtctctctctcttgcccaggctggagtgcagtggcgcaatcttggctcactgcaagctccacctcccaggttcacgccattctcctgcctcagcctcccgagtagctgggactacaggcgcccgccaccacacccggctaattttttgtatttttagtagagatggggtttcaccatgttagccaggatggtcttgaactcctgaccttgtgatccgcccgcctcggcctcccaaagtgctgggattacaggcgtgagccaccgcacccagcctatcttctctctactttctatgtgtttgaaattttctgtaataaaaagtttttttttgttgttgttgtttttgaggtggagtcttgcactgtcgcccaggctggcgtgcagtggtgcagtctcggctcactgcaacctctgcctcctgggttcaagtgattctccctcccgggttcaagtgagcctcccaagtagctgggactacaggtgcacgccactatgcccgtctaattttttgtatttttagtagagacgggatttcaccatgttgtccaggctggcctctaactcctgacctcgtgatccgcccatctcagcctcccaaagtgctaggattacaggcgtgagagccaccgtgcccggccaataaaaagttttttagagaggatcatgcctgtaatcttagcccattgggaggctgaggtgggaggatcgcttgagctcaggagttcaagatgagcctggggaatatagcaagaccccatctctatttttttttttttttaatcagtggtttgtgctaggtactgtgagggacagaaacagagaagacagggcaatcctgccagctcctcgtctgctgtggacaagccatttgtccttgggtgccaaaccaccctccatttgagctataaagtgtcaaataagtgggaattaggagtatgcaaacaagtaatgatggctgggcgcagtggctcacccctgcaatcccagcactttgggaagctgaggcaggcagatcatctgtggtcaggagttcaagaccagtctggccaacatggtgaaaccccatctctactaaaaatacaaaagttagccgggtatgatggcacacgactgtaatcccagctacttggaaggctgaggcaggagaatctcttgaacctgggaggtggaggttgcagtgggccaagatgacaccattgcacatcagcctgggtgacagagcgaggctctgtcatttaaaaaaaaaaaggaatgatacttaccgccactgcccagggatcaagagaaggtaacagaagcaggatgtatcgtgacagtgggtccggtgccagccagctgccgcttccggccggagtcaagcacccatgtttctgttagttactggctgggctgctgttctctgccctcgtgcttgaaaagcttgacacagtggtggtctcatgtcacatctgccactttcacctctgctggtggcgttagaatcagtaatggatatggaggtggtttaccaagcagaggagtgagatggtggttggagggggcaggctttagcatcaccctcacctgggttcatatcccaactctgccatttattggctgtgttactgtgggcaagtagtgtcacctcctggcttccgtttcctcgtctgagaaatggggataaccttatttgtttttttgttttgttttgttttttgagacagtctcgctctgtcgcccaggctggagtgcagtggagcgatctcagttcactgcagcctccgcctccaggtttaagtgattctcgtgcctcagcctccccagtagctaggattactggcatgggccaccacaccccagttaattttggttttgtttttgtgagatggagtttcactcttgtcacccgggctggagtgcagtggcccgatctcggctcactgcaacctctgcctctcaggttcaagcgattctcctgcctcagcctcctgagtagctgggattactggcatgcaccaccatgccccaccatgcccagctaatttttgtatttttagtagaaacggcatttctccatgttggccagactggtcttgaactcctgacctcaagtgatctgcccacctcagcctcccaaagtgctgggattacaggtatgagccaccatgcccatcccgtgatacccttatttggcagtgacactgatcgtgagaggcttcgtggaaaggccatttacctggagactccacacattgtcgtccagtgttccctagagccagccttcctccagtgctgtgagaggaggcagattgttctcgcctctagatgaggtttactgggttcatgtcagattccgggccaggactctcttcagaagggcaggtctgagccctgtgttttcagccgtgcagtggccagctgtggctggtgtccacactcccatgtgctaatggagatgcccaaagaatgtgtccaaagccagtccctgcaggtgcttctgcaacgcacttctgcacactctgctcacttagctgggacaagggaagctggagaacgtgtgtgctggtgtccctgggcaggctgagtggaagagcattttgtcactagcagtcaatccacaaacatcactatggctggtggtgggccaggcctgacctcacttctgccactgggagttgtctggacttagcacctccaccagaacaaatgagggggcacaactacaaactcagcagttcttttgcacagagagaagcttggccagatcatacacctaaccctcaccaacctggagtgcccaggggagagaatccagccctgctgttgtgaacacacagtgacaggattgtctccttgtgtaaaatgtgcagacattggtctcttagaacttcgaggacccaaactgtactttgatctgagtttctctggtgaattatacaatgtgcatgcttacttaataaatgcttgataacccctcattgatagcacatcatgagtcacagtcctagcctgacctgtgaattatatgaaaagcctgaacaaatagacttacatggcaacacttctcagttattgtgtttaaatatagtatgggcatggtgctcacgcctgtaatcccagcactttgggaggccaaggcaggcggatcacctgaggtcaggagtttgaaaccagcctggccaacatagtgaaaccctgtctctactaaaaatacaaaaattagccgggtatggtggcgtgtgcctgtaatcccagctacatgagaggctgaggcaggagaatcgcttgaacctggaaggcggaggttgcagtgagttgagattgcaccactgcactccagcctgggtgatatgtgcgagattccatctcaaaaatgaataaataaataaataggccaggcgcggtggctcacacctgtaatctcagcactttgggaggctgaggtgggcggatcacgaggtcaggagttcgagaacagcctggccaacatgatgataccctgtttcttctaaaaatataaaaattagccaggcatggtggcacacgcctgttgtaatcccagctacttgagaggctgatgcaagagaattgcttgagcccgggaggtggaggttgcagtgagccgagatcgcacaactgcactctagcctgggcgacagagcaaaactgtctcgaaaaaataataataaataaagagatagataaaaacgtgtgtgtatatatctacacccactatatatatatatatacatatatatatagcattatataatacattgtattatatctataatacatatgtgtatgtgtgtggttttctctttgtaattctttttcagtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggcaagagcatctttcttttttgtttggattttcttttctttgcagtttctggcttagcaaaagaaagaaacctttaacatgggcaagaacagggtgtctccatgtccccgtgtccccatagaggctgagccctgagcctgttttcattgtcctcttcaagacctgtttttccactcggtttgctgagacctccctccgccaggctgatctgaagggccagccatcctttgatgtcactctgtgtcccttgtgtggggttgagactttgccggtgccctgcttacgatgcctttgccacgctctgtagtttggaggaggttttagtgggcctggttctccatgaggaatccacaactacagcctgcaaggcttaactgtataaatgtttgaacagtttgtgaaaagggcacatgcgaaatcggggggaaacagagggagaaagagctttccagagagcagtaccagcaggtatgagaaggcgtggcatacgtggagaactgcaggtgcttagattggtcagaaatgcaatccacaaggggctgtggcaggtgctcacgttgacagaggtgcatgacatcagagcggcctggtcagcctcggggagtataggaaaaagcatcatggtcttgaagcatctccagtgcctaaattatcctagctgcatttaaggaggttctgttatctatgggaacttcatgatttcctaaattcaacattatgatggtttttgataataagagcttacatttattgagagcttcctttgtgtttggctctgggccagaattttagatacttcatctcatttcatcttttttttttttttttttttgagctggagtttcgctcttgatgcccagctagtttttgtatttttagtagagacagggtttttaccacgttggtcaggctggtctcagactcctgacctcaggtgatctgcccaccttggccacccaaagtgctgggattacaggcatgagccaccgtgcccggcccatttcatctttatactaatccgtttgcagagagagaatccaagtcgttaagtggcttgcctcaggtcagcagcgaatcactggcagagcagagcagagcagagatgcctagcttcagagccctgctcttgaccaccatctttttctgccacacgctttgtatctgcacttctccttcattttttttttttttttaattattgttctttttttgagacagtctcactgtcgcccaggctagagtactgtggtaccatcttggctcactgcaacctctacctccccggctcaagcagtccacccacttcagccacccgagtagctggaactacaggcctgtgccaaccacacctggctaatatttttaaatttttttttatagagatggggttttgccatgttgcccaggctggtctcgaactcctggtctcaagcgatctgcccacctcagtctccaaaagtgctgaggttacaggcatgagcccgttcccagcctcctcttcatttcattatggggaatatgaaactgggaagagtgagactcactgaaaaacagacttagcatctaggaaatagggaaaaatcatttctccatatcagagctcaagatctgggtcgattagaatagagggagcctggcagaatccagaagagagactctgcctcttccaagtctgtcctctccaactggatacggtgccggaaatgcaagagataggatgggccctctggccacgcttttctccaccctttggttgctttcttcactcgagggcaccgtgttgccatgctccctccccaagggcccgcccatacttttgtttttttaggatggagtccatccacttctctgcactgagtcagcccccagagggcgagttgccacttgtatcctagagctgggcagggctgcccagcactggagaactcagctccaggaccctggggccagccttgttgagcagcaagctctaatgaagagcacacagaacaggcttccactgcctgggacccgcttagcaccatgtcacttagcctctctgggctgcagcttcctcgtgtataaaatgaaacaactgagctataagctggagcctgtgaagaggagcagccgtgagggcccccaagtccctttcctccatttgaccagagcatctgtacttggcttccatgatcaaaaggttcaaggatgaaaatgactctgaaagccaccaatgtgatctttgttccagctgtgagtctgtgtgttagggtccccaagacccaccctagatcgctcaaaggactcccaggactcagcacagagtcacactctgatttcgttttgagacagaatttcactctgtctcccagggtagagtgcagtgccacaatctcggctcacgggttcaagagattttcctgtctcagcctccacatctgtgcctggcccatactctgattttttatagcaaaaggatgcaaagcaaaatcggcaaagggaagaggcacatggaggaaagtccgcaggtgtccaggggtaggcttccaggagcccttcctgagctgagtcacgcaggatacacttcattgctccaccagcaagctgtgactgcacatgtgaactgttgtctgccagggaggcttatgagagacccagcgcccagggctttttctgggggctggccacatacgcaccctctgtgtagcgtatgccaaaattccgactcccagaaggaaaacagatgttcctcataaagaaaacacattgtgcaaacagtgtagggacggtaagccaccttaccagtttgggaatgggagggataaacttgaaatccaaattcccaggctgggcgcggtggcttacgcctgtaatcccagcactttgggaggccgaggcaggcagatcacttgaggtcaggggttcgagacaggcctggctagcatggtgaaaacccatctctactaaaaatacaaaaattagccaggcgtggtggtgggcacctgtgatcccagttactcaggaggctgaggcaggagaattgcttgaacctgggaggcagaggttgcagtgagtcgagatcacactactgcactccagcctgggcaacggagcaagactccgtctcaaaaaacaaacaaacaaaaaacgcacacaaattcccagatgtcagctaagggttgacctggaaatcaggcccttcaaagggcattagtgttaggcctgttacgttagctcttctgcagtctgtgactctaaattttaggaattccaattgaatgctgaaataaacccaaagggaatttttgtccttaaaatcgtgtcttcctctgccctggcagtccaacaccattaaacagaagaaaagaaaatgtaaaaccatcaagtaatactattattcatagatcatacaattacttttatatttttattttttaattttaatttttcagagacaatttcactctgtcacccaggctggagtgcagtggtgcagtcatagctcactgtagcctccaattcacaggctcaagccatcctcccactttggccttccgagtagctgggacttataggcatgcaccaccatgaccagcttatttttttattattattttctgtagagacggagggagggggtctcactatgttacccaagctcaaactcctggactcaagtgatcctcccacctcagcctcccaaagtgctggaattacaggcatgagccaccatgcctggcctatttttgtattttaaaaaataacaacatgttctgtatttgaataatctgccttttttcagttaacaatttagcagccttgtcttcccatgttttcaagcatatgttataccaccatttcatgtggctgtagtggattatattgtatctcaaaattagaaaacagttctttgcaagaaaccctatactgccataatagggtatcgctgttttccactttggtatgggacaatgacagccttgccaggacaacaggagccattgcctggaagaccaggtggggaggcagcaaggcctgctcaaggcagcagagggatgcgcagaggagacacagaaccttcctagagtctagggtccagttgtctcctgatgacataaatccttaaggtcattttagctgaaactataggaggctcaagcacatttcggtcaaactagaagcaggttgggaatgaaaggaacattatttcccagaataattttttctctgttgactaacttgaggtatctagattaaccgtgagatacaaaatgttggccaggcgcggtggctcacgcctataatcccagcactttgggaggccgaggcaggtggatcacctgagatcaggagctcgagaccagcctgggcaacatggtgaaaccctgtttctactaaaaatacaaaaatgagccagacatgatggtgggtgtctataatcccaactactcaggagttggaggcaggagaattgcttgaacctgggaggcggaggttgcagtgagccgaggtcgcaccattgcggtccagcctggtgacagagcgaaactccatctcaaaaaaaaaaagaaatacaaaatgtttgttttgagatggagtcttgctcttcatccaggctggcgcaatctcagctcactgcaccctctgcctcctggtccaagtgattctcctccctcagcctcccatgtagctgggattacaggtgtgtgccaccacatccagctaatttttgtacttttagtagagactgggttttgcaatgttggccaggctggtctcttaactcctgacctcaggtgatccacccaccctggcctcccaaagtggtgggattataggcgtgagccaccccatccagcccaaaatgttaaaggagaaaaagattatcctagaaattgggatttactgaagtctagttactacaatgggcactctgagacctcacagccagaaacacagttctaaagctatcagcctctttggccacacaacacaccaattttcacacataaaatgtgtccactgccagccagtgacccactaaaaatggcatcttgttcttctttggttgtcgtgttcacagtgaatttgaggaaacatcagaaaagatgtaggcagcttggccatgttcatttacatgtgtgcttgtgatgtttttaaaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatggtaaaatataccttcttatgtcctttctgaactgggaaaagaatactcctccaatagtgaaatcggggaatgcttatgaggtcatgggtggtgggagtggggagacccagtgagaagagtgctgaactgcaggaataatgagcttgtgctgagatttgcagtagtggaggctaccagacagctaccacttgctttatttcattacaggattgactttagctattaatgtaagcataccaggtgagggtggggggtagagggacttgcccattttactaggacaggaatgctctttaagcagcatggatggaacattaactgatgtttgtgttgtgcgtaggaagatcattctgttcactttcgtgtcctctttttagcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagaggtacgtgtgcacacatctctttttttttttttgagacagggtcttgctctgttgcccaggcgggagtgtcatggtacaatctctgctcactgcagcctccatctcccaggttcaagcgattctcctgcctcagcctcctgagtagctggtattacaagtgctcaccaccatggcctgctaatttttgtatttttggtagaaacagggttttgctatgttggccagactggtctcaaactcctgacctcaagtgatccacccacctcagcctcccaaagtgctgggattacaggcgggagccactgcgcccggccacgcagacatcttaatggtgacacatcagggccccactgcccctggcaacccctaagagtgcagctgtgggcaaagccgtggacacagagatttgggttacaaatggtatggggttgtttgtacacccatgttcatgttgacacgattcacaacagccaaaaggtggaagcactccggtgtcgttgaaggattaatagataaatctttaatagatggtctttccatacaatggaatatcattcagccttagaaaggaaggggattgtgacacatcctaccacacacatggaccttgaggacattatgctgagtagagtagggcagtcacaaaaggatactgtctgcttccacttaaatgaggtccccagagtcatcaaatccataaagacaggaagtagaatggtggttgcggtggtggagggagggaagtgggaagttcgtgttgaatggggccagagtttcagttctggggctgtacagagttctggagatggatggtggtcatgattgcacaatgtgaatgtgcttggcactaccgaactgtacacctaaaaagagttatgatggtacattttatgttatgtgtattttaccacaatttaattttttttttttaatggcatggggttggctaaaaaggtggcctggcctggagattggctgcagtagacccctctccgaggcagcaggtctcctctgctgtctggagaatgctccagggaagtggcctggctggaggacgtgaaggcggtggagacagtgatcaggagcttgagctttggggcccacagggtgcttaggagggccctaaggcagagtcaacacccagagctgtgagtgccaggccccgtgtacccattgcccagtgggtattgctaatatttgaaaggacttgagaaagaacagtagcgtgggtcttgtggaaagtcttattttcctgcataaccccagccccctgaggctctgtgaggccattgggccttctgaggacacggtcaggacattttggggatcagaggcgagctgagagaagaacatttaaaaagcatttgcagccgggcgcagtgacccacacctgtaatcccaggacttggggaggccagggtgggcagatcacctgaggtcaggagttcgagaccagcctggccaacatggtgaaaccctgtctctaccaaaaatacaaaaattagccgggcgtggtggtgggcgcctgtaatcccagctacatgagaggctgaggcaggagaattgcttgaacccaggaggtggaagttacagtaagccaatatcgcaccatagcactttagcttgggtggcagagcaagactccatctcaaaaaaataaaataaataaaaagcatttgcttctggaggcttcacattattcttgggtaaacctagagtaaaggtgttggaagcagaatgttactcagttacatgtgggatgaacagaggttagataaggtccaagtctgcagaaacatagcagcactttcagaaagaaccctagtcacttgttccttcatctgccatgatgtattgtaggtacacaggcagtatacagattccctactagaacctccctggttaatattgtcacaaaatcacagctcctaacaggtctcagaatcttacttgcagtaataatctctctctctcctggtagaactaccagctgagccccagtacatgaatatactatgagtcattcctctgagacatgaacagaaaacacaggcctgtcagttcacttttctaggaaagcataaagaacatccgccaaaggtctctgagttacatgggaacagtgaatcatgtttcacttataattctggggtttcacaagggtacatgttttggttttgttcctctttcagtcagtcagctacaagcttattgtcttccagtatctttcagcatttccaagagctagacactagattcttggtaacttggtgaatctatggctaagcctaaagcctgcgggagcaaaagggaaattaatcgctgggaaacacccctttatatgttaaggcctaaggccctcgctcccagattctctgcttgctgtgcgctggtgcaaggggaggggtggaggagtgcctgagaccaatgcttgtgaacttgccctctttttccccatcacagctgaacaagagcccccagtccctccttcactgaaaggttacaattttagagacgtcttaagattaataacccacaggcctacactgagggttgcaaggaagaacttgcttttcttccaatcagaaaatcagaagaaaaaaacaaaacttgcttttcctgagttttgcccttttaaactctcagcatattaacatggtcagccctgggatgagtattaaagtgattactgagatgaggggtaaggagtattcaactattagaagttgttggctgggtgaggtggctcatgcctgtaatcccagcactttgagaggccgaggtgggtggatcatgaagtcaggagatcgagaccatcctggccaacagggtgaaaccctgtctctactaaaaatacaaaaattacccaggcatggtggcatgcgcctgtagtcccagctacttgggaggctgaggcaggagaatcacttgaacccaggaggcggaggctgcagtgagctgagatccacgccactgcactccagcctggcaacagagcaagactccgtctcaaaaaaaaaaaaaaaaaaaaaaaaattagccagccgtggtggtgcacgcctgcaatcctagctacttggttgggaagctgaggcaggagaattgcttgaacccaggaggcggaagttgcagtgagccgagatcgcgccactgcactccagcctgggcgaaaaagagactgactcaacaacaataaaaaattgttgccgggtgcagtggctcacacctgcaatcccagcactttgggaggccgaggcgggcggatcacctgaggtcaggagttcgagacagcctgaccaacatgggaaaccccgtctctacttaaaatacaaaattagcagggtgtggtggtgcatgcctgtaatcccagctacttgggaggctgaggcagaggttgcagtgagatgagatcgtgtcattgcactccagcctgggcaacaacgtgaaactccgtctcaaaaaaaaaaaattgtttcattgttgaataaaaagaaaaataagttatgtcattggtggacagaatcaacttatatctgaataaaataactataccaattaaaactaaagtaggccaggcgtagtggctcacgcctataatcccagcactttgggaggccaaggtgggtggatcatttgcgatcaggagtttgagaccagcgtggccaacatagtgaaaccctgtctctactaaaaatacaaaattagccaggcaaggtggtgggcacctgtagtcccagctacttggaggattgaggcaggagaatcgcttgaacctgggaagcagaggttgcagtgagctgagatcacaccactatactccagcctaggcaagagtaagactccatctcaaaaaaaaaataaaaataaaaataaaataaaaacaaaaactaaagttaaaaggtctggtatactgaactggtaaactaattacaattttgctttccaacctcctcaagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtcta

SEQ ID NO: 1766 - DNA, 7183 bp, Homo sapiens
  source 1..7183: mol_type = genomic DNA
ttctggttgacaaagagggtatttatttagggtttactgggtacagggagaagggctggatggcttgggatgcagagagagacccttcccctgggatcctgcagctccaggcccctttgggtggggtcggggctgggaacctatgaacattctgcaggggccaccgtcttctccacggtgctcccttcgtgcatgacctggcagctgtagcttctgcgggacctccactgctcgggcgtcaggctcaggtagctgctggccgcgtacttgttgttgctctgtttggagggcgtggtcatctccacgccctgggtgatgggggtaccatctgccttccaggtcaccgtcaagattcccggataaaagtcattcatgagacacaccagtgtagccttgttggcttggagctcctcagaggacggcgggaacagagtgaccgagggggtggccttgggctgacctgtgtggacagaggagggggtgagagatggcagagggagtgtggggtgttgtggagcgcctctctctgtctaaagtctctgggagggttcatggtgtggccgcctggtccacccagggcctctccttccctcctcattccctcctttccactggagccctctggagagcagacagccctgtgccttcctaggagcccttcccaagtcacctttcccaggtgtcctggcccagccctttcctctgcagcctcggtttccccgtgtgcacccagggcaggctgtgctccctccttcctggtttctggagtctgagtttggaatctaggggtctccctcacagcacacaaaactatactggcaggatgtggggagacccaagcctggcatggcctggagcttcccatcccctggggcaccaggctgtgccccagcctggcccactcagctctcctggtgaagcgtgggctccacccagacacaccctggggctctgccgtcgcccctgtccccaccagcccgaccacaggacccttcacatcggctgggttcttggggctgctcccccagactttggggcaccgcagcccccatgcccaccccagcagcctctgatgcccctggacttcacctggcagccatggagttctctgcactcccgtttactccccgctagtcaccttctgagtctaaggtgcccttcctcaaatgaaggtgggaggtcgacccatgaacagagagacaccaggccccagagatgacagggctccagggacaggcacatctctgcactaagagaccctctcctttctggtgactgtcctgggagggctgggctctgggacctcatccgttcctctgtgtccccatgccctgaagacccagcagaggccacagagctgcagcctagacccagagccctctctgtgccctccattggtctcccctgggggtgacccctgtgtccccaggcccccgtgtggccctcccaggctggatgggcatccagccctcagcctagaacctggggtcccagggactgtctctaaggccactgcagggcccctcatcagaaccagcctctgtccctcactcagacatctgccctgggagaggggaggagccctgaccccgcccaatcccagcccaggccctgggaccaggctgtgtcctgctgttggaacctgaaggcggctgctcccactgtgggggcccttcctgccattaccctgagactaacacatctcctccaggccccatggacaaaggtaggggtcagtgcttaaggctgggagggcagaggggaagaagccccagagagagaaaacacattttccagagacaggagagggtgggacagcctgggaagttagagccacttacttaaaacggtgagctgggtcccgctgccaaacacatgcgtcactgagttatgcttggattgaaacccccggggccagcacctggggccagtccaggagccgcgctggagcaggaacctgctgggagtgaggggcacagggctgcagtgtgtaggctgtgacccaggcacagggtaggggggtggccagtgtcccagtagtgtcccccagtagtgtctctgtgcctgtcccttctctgaggcaggtgctgccccagcgtgtgtccccctctctgaaactgttggtgctgatggcaacgctgggcccagtaggtcccagcaactccctgagtgacacatcccctcaggcagctgtgccgtgtggctgaggagtcctcagctggctcggacctgtccacctcacttggcctcattttaagggcctctgaaatctgccacaagtgtccccagtcaaggaggctgacttcctccctggaccaggacattgggtcattcctgactcaagaggagagtcctctgcttttatatctacccatggagatgcagctcagtctcactttgttcatgaagccttttctgatcattcattccatccgtccgtccatccatctgtccatctgtccatctatgcatctgtccatctattcatctgtctttgcatccatctatcatctgtccattcgtccatccatctacctgtccgtccatccataaatccatcctgtctaccaggcactgtgtgctggggacatggtgtggtcccccaggctctcacccccatctctcccaggccatggtcaacaaggccctcctcatggtcatgtccaaggtccttctgctgtacctggtgtctccgctggatgcgacacagggctggcccctctttccagtgactcttttccccttggggtctgagactcccctttcctcttcccctggcatctgtttctccatggcccatgcctggctgctgactccccagaccccacccagacctctttcttagccattttcacactctgtgacccccactattgcccacatggtgaggctggagtctatcccagctccaaaccctctcagctcctcaattgcctactgaccttgcccagtgggctacccaacaggagcctcaaactaatcacgtccagaggagatgaccaccttcccccagcccagctcattttctgtcttcatctcatcacaatgaccatgggcggtctcaacccctcagccagaaacctggagtccctggactcagtcacctcgcctcccacactgaaatggcttctgcgaacttagctactgcatctagacattctttttttttttgagacagagtctcgctctgttgcccaggctggagtgcagcctggcaacagagcaagactgtcccaaaaaaaaaaaaaaaaaaaaagaagtgtcatattgatctctccctctctctcctgctatgtacagtcccatttccttttatttttttgaaatggaatttcacccttgtcgcccaggctggagtgcaatggtgccaccttggctcaccgcaacctccacatcctgggttcaagcgattctcctgcttcagcctcccgagtagctgggattacaggcatgtgccagcacacttggctaattttttgtattttcagtagagacggtgtttctccatgtttgtcaggctggtctcgaactcccgacctcaggtgatctgcccaccttggcctctcaaagtgctgggattataggtgtgagccaccacaccccgctccatttttatacatagcatcaatatttccactttaactatttttaaacgtacagctccgtggcactaagtacattcacaccgttgggcaaccttcaccaccatccatctccagaactctttcatcttcccaaacagaaactctaaacccgttaactacagtcccccattcttccctccccctcaccctgctaacctcaaatctactttttgtccaagtgaatttgcctattctaggtacctcatagaagtggattcaaatgacatttgtccttttgtgtctggcttatttcactaagtataatgtcttcaggtttcatccatgttgtagaagatttttgaaattaatttaaaaataattaacattcaaaacctattaagacctattaaaaatagtacaggctaggtagggtggctcacgtctgtaatctcagcactttaggaggccgaggcgggtggatggcttgagcccaggggttcaagaccagcccaggcaacatggcgaaacctcatctctacaaaaaattatgccggtgtggtagcgcatgcttgtagtcccagctactggggacgctgaggcagggatattgcttgagcccagcagttggaggccagcccaggcaacatagtgagacccccatctctaaaaaaataaataaaacaaataaatttacaactaaatataaaaagtgatacacaacctatttcttaaaaacaatgaaaatatcttttaataagctatgaatagaaaagtcatttatttgataggagatatttaccagaattctacaggaataatcagtcttttttttttttttttttttttgagacagggtctccttctgtcacccaggctggagtgcagtggtgggatctcagcttactgcatcctcaacctccgaggcttaagcaatcctctcaccagcctcctaagtagctgggaccacaggcaagtgccaccatgactagctagtttttatatgttttgtagaaatggggtcttgctatgttgctcaggctgatctcaaactcctgggctcaaacaatcccgcctcagcctcccaaagttgtgggattacaggcatgagccactgcacctggcccatagtatttctaaagattataaaaactcatattcatatcccccccagcataatacctttttttttttttgagtgggagtctcgttctgtcgtccaggctggagtgcagcggtgcaatctcagctcactgcaacctccacctccctgattcaagcgattctcctgcctcccctcccgagtagctgggactataggctcgcgccaccacgcccagctagtttttgtatttttagtagagacggagttttgccatgttggccaggatggtctcaatctcctgacctcgtgatctgcccatcttggcgtcctaaagtgctgggattacaggcatgagacacagcacccggcccatagtatttctataagatttctaaagattctaatataaaaacttacattaatagccccccaacataataccattttttattatctgtgtctccctccacctgtcacccgtcccttgtggagacccctcgggccttccccatcccagtctctgttctgtaggcatcaccctgcatgtggctgtctcctcacccggcccccgctccttgtggacttgaattggggcaaatctagatcctctgggacctcagccccagcacagagcctgaccctgatggggactccttgctcagaagtccgtgcaggacactgacacccggtcccggcctgccaccatgctgaccccgcctccatggccgggctcctggtgtgggtcaggtcggctgccactgctggagctctcaccacagccaccccagcatcctctgggtgggtgggacgctgaaggccctcaccagtcagggcccctcagattgcagaaggggaaactcaggcccggtgtggtgtctcatgcctgtaatcccagcactttgggaggctgaggtgggtggatcacctgaggtcaggagtttgagaccagcctggccaacatggtgaaactctgtctttactaaaaaaaaatacacaaaattagccaggtgtggtggcagatgcctgtaatcccagctactccggaagctgaggcaggagaatgtcttgaacctgggagacggaggtttcaatgagccaagatctcgccattgcactccagactgggcgacaagagtgaaactctgtgaaactttatttgaaaaagaaaaaaaagagagaaaaagggaaactcaggtcccagagatgcacgtgtccgctcgatcagcttagaggatgggacaggggagagctagaggggatagcttgggccttagaatctgtgcccatgagctgagtgactcggacgggtcacctcacctctccgggctctatccccgtctgcacaaaggggatcacagcaggacctgcctatggggccaccgagagggaggttctgcccctgaaatgattatcgcctgtgggtataacatgcaccagtgaacaggctgttgtgtcccaaatgctcataaatggaccccgatgcttggtgctttgtctggggacctcccaccacacgcagagtggtggcaatggctgaggtcacacagggagttgtggcctccctagagcctctcctgggcttcttctttggaggcacttgcaccctggataagcttgtgtctcctaggggctggtttcaggaggcgatgctggctgaggtctagtgacccagggactccaggaaaggcccctcacaccttagctggagctccagggagtggcccctgcccagtgagggtgggagtggacaggtgacataggccaaggggaaaagaggaggggggggaggaggagtgggaggaggaggagggagaggcctgggcatccttcagggatagcggccaccactcctgtggacgtcctgcccctgcctccagtcctgccctaccccaaggactagggggaggtgagggagacattggccttggtgccaaatgtaagtgggggaagaaatctcaggaatcaagataaataatattttaatatgacattaagcaataaaaattaattcaaagatggacaaaatcttgacactttagttaaagtcagtgtctgtggctcccctccagggattaaccttcctcctcacccctctggctcgtctccccttggtcatcctttcccgcctctgccacccagacccccacatcccctggaatctctcaccccttacctgccccaccggctcctcaggctggaccggctgcttcctccaggggctccagggcccagggccctgctctgcgatgcagctgttgggcgcagcaggccatgggttaccacggccagacccagcagcagcaggggccagcgctgcctgaggttggggcctggctcaccaggggcctcaaggcccccctggcctgtccctggcctcatcggccctcagggtcagaggtccttgtggcctgacttgcagtgtgggctccctagagagtggtgccctggtccctctcgctggcagcagctgtcccattgcaccccagtccatgtggcc

SEQ ID NO: 1767 - DNA, 7183 bp, Homo sapiens; identical to SEQ ID NO: 1766
  source 1..7183: mol_type = genomic DNA

SEQ ID NO: 1768 - DNA, 61352 bp, Homo sapiens
  source 1..61352: mol_type = genomic DNA
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggtgagtccccctcgtgggtgcggcccgggtgccacctgcaggccccgccgccccgctgcctgcaaggcccggaagacccctctgtgccgctgggaagtcgcagcttgcggactggggagcgtttcacttgtgcgggttggagttcgggaagccgggagaaacagctctccctggggtggcttcttgggggtgggtggctttgaggggaacctgcgatttatgggaacattgtaaagaaacacgtgacctcggcgatgctcagaagtaggttctgcccctgccacctcgggcagaaggcgggcaggcccgggcgcccctggtggagtcagctggggatcccctcgctagggcaagggcgtgggcatcgcctccctcggtgactttcttccttgcctgatgccacagcaaccggatgggggagggtgagagggacaaaagtttgccacaaagtttggaccaaccaaacacattggtttctttacaaaataaaaaaccagttgtatttttcttctctcccattcaagagcagtggtatctcttgccttctccatccctttgagctccatttttttcttaatcctaaccttttttccccatcccaaattgcttatagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagtaaaataaagttaagctcttagtctctattatatatatatggtaacagtagaatatcatgtactaatatatactgatattatatgttataaaacatatagaaataggaaaatttaaaggatgagactaaataaataatttaaaatattttaattccttgaggccagtagttcaagagcagcctgggcaacatagcaagacctcgtctctacaaaaaaggtttaaaaattaggcagccagctgggcgtggtggcttatacctgtaatctcagcactttgggaggctgaggcaggcggatcacgcagtcaggagatggagaccatcctggctaacactgtgaaaccccatctctactaaaaatacaaagaattagccaggcttggtggcacgtgcctgtagtccccagctacttgggaggctgaggcaggagaatcgcttgaacccatgaggcggaggttgcagtgagccaagattgcgctactgcactccagcctgggtaacagagtgagactccgtctcaaaaaaaaaaaaaaaaaaaaaaccttaggcagccttggtgcgtacctgtagtcccactacattggaggctgatgtgggaggattgcttgtccaggagtttgaggctgtagtgagctatgattgtgccactgcactctagcctaggtgacagagtgagaccttgtttcaaaaccattttttaaaaattattttaaatgtcgggtgcagtggcttacacctgtaatcccagcactttgggaggccgaggcaggaggatcacttgaggtcaggagtttgagaccagcctggccaacatggtgaaacctcatctctactaaaaatacaaaattagctggtgtggtggtgcatgcctgtaacttcagctactcaggaggctgaggcaggagaatcgcttgaacccaggaggcagaggttgcagtgagccgagatagtgtcactgcattccagcctgggtgacagaatgagaccctgtctcaaaaaatatatatatatatatatatttaaaatatttgctaattatgatgtcttcccagtattgcttgcgatactgcacggcaaaaaataagcagatccacatgaaagtgagaattcatttagaatgatgatgaaaatccatatttcaaataattaacatttttttaaattttgtagagatggggtcttgctatgttgcccaggcttgtctcaaactctcatcctcaagcagtcttcccgtctttgcctcccaaaatgtttggattacaggcctgagccatgggacctggcctcagctgaggttttttttttattttttgtagtgatggtggtctcacaatgttgtccaggctcgtctagaactcttggcctcaagtgatcttcctgccttggcctctcaaagtgctgggattacagccatgagtcattgaacctggcctgtttttatttttaattgacacataataattgtacatatttatggggtacagtgtgatattttgatacataatgtgtaatgatcaaatcggggtaattggcgtgttcatcacttgaaacacgtatcctttttgttggaaacagtcaaaattctttcttctggctattttgaaatatacaatatttttttttttccggagacagagtctcgcactgttgcccaggctggagtgcagtggtgtgatcttggctcactgcaacctccgcctcttgagttcaagtgattctcctgcctcagcctcctgagtacctggaattacaggtgtgcaccaccatgccagctaatttttgtatttttagtagaaatggggtttcaccatgtaggccatgccggtctcaaactcctgacctcaggtgatctgcccacctcagccacccaaagtgcttggattacaagcgtgagccactacgtccggcctgaaatatacaataaagttttattcactgtagtcaccctgttgttctttagaatactgtaacttattccacctaaccgtaattttgtacccattaaccagtctctccctatttccctccacaactccccccacccccaccaccctttcctgcctctggtgaccactattctactttctacttctgcgagattagtttgttgttgttgttgttgttgttttgagacggagttttgctcttgtcgcccaggctggagtgcagtggcgcgatcttggctcactgcaacctctgcctcccaggttcaagtgattctcctgccccagcctcccgagttgctgagattacaggtgcctgccaccacacctggctaatttttgtatttttaatagagacggggtttcaccatgttggccaggctggtctcgaactcctgaacttaggtgatccccgccggcgcgcccccccccccccccgccatcccagcctcccaaagtgctgggattacaggtgggaactaccgagcctggacgagatcagtttttttttgtttgtttgttttgttttttgagatggattcttgctctgttgcccaagctggagtgcagtggcacaatcttggctcgctgcaactggtgtctcccaggttcaagcgattctccagcctcagcctcccaagtagctgggattatagccgtgcaccaccacgcctggctaatttttgtatttttagtagagacagggttttaccatgttggccagtctggtctcaaactcctgacttcaggcgatctgcctgcctcggcctcccaaagtactgggattacaggcatgagccactgtgcctggcatttttttttttttaatttttaatttctttggagatagggtctcaatctgtcatccaggctgagtgcagtggtgccatcatggctcactgtagccttgacctcctgggctcaaatgatccttctgcctcggcctcctgagtagctgggactacaggtgtgcgttgccatgcccggctaatttttgattttttgtagataggaggtctgtctgttgcccaggctggtctcgaattcctggacacaagtgatcctcccacctcagcctctcaaagtgctgggattacaggtgtcagccaacagactttacccaactgagatcagttttttattagctcccacggatgagtgagaacatgtggtatttatctccctgggcctggcttaattcccttaatgtaatgccctccaagctcatccatgttgccacagatggcaggatttcattcttttttatggctgaataagagtacattgtgtctgtgtaccacattttctttgttcatttgttcattgatggacatttaggttgattacatattttggctattgtgaatagtgctgcagtaaacgtgagggtgcccatatctctttgataaactgatttcctttcctttggatagatacccagtagtgggattgctggatcatatggtagttctatttatagtttttcttttttttttgagacggagtcttgctctgtcaaccaggctggagtgcagtggcatgatctcagctcactgcaacctccgcctcccgggatcaagcagttctcctgcttcagcctccaagtagctgggattacaggtacatgccaccatacccggctaatttttatgttttcagcagagacggggttttaccatgttggtcaggatggtctcgaattcctgacctcaggtgatccgcctgcctcagcctcccaacctgctgaaattacaggtgtgagccactgcgctagccttgtttgtagtttctcaaggaacctccatactattttccataatggctgtgctaatttacattcccaccaatagtgtatagagttccgctttctccacatccttgccttcatttgttactttttgtctttctgataatagccattttaactgtggtgagatgatatctcattgtggttttgatttgcatttgtctgatgattagtgatattgaacattttatcatatacttgttggccatctgtatgtctgagaaattcctgttcaaatcatttgcccatttgaaaaattggattatttatttttttgctgttgaattgtttgagttccttgcatattcttgatattaatcccttgttggatggatagtttgcaaataatttctcccattccataagttgtctccataggttccataggtttattctgttttttcttttgctgtgcagaagctttttagtttgatgtaatctcatttgtctacttttgcctctgttaactgtacttttgaggtcttatccataaaatcttttcccagaccaatgccctgaagcacttcccgtatgttttcttgtttttttttttttgagacagtctcactctcagctgagacaggtgcgatctcgggtcactgcagcctctatctcctgggttcaagcgattctcctgcctcagcctcctgagtagctgggattacaggcagcgccatcacacccggctaattttttttttttttttttttttttgagacggggtctcgctctgtcgcccaagctggagtgcagtggtgtgatctcgggtcactgcaagctccgcctcccgggttcatgccattctcctgcctcagcctcccaagtagctgggactgctggcgcctgccaccacccccgactaattttttttttgtatttttagtagagatggggtttcactgtgttagccaggacggtctcaatctcctgaccttgtgatccgcctgctcggcctcccaaagtgctgggattacaggcgtgagccaccgcacccggccacgtgtggctaattttttttttttttttttttgcaacggagtcacgctctgttgcccaggctggagtgcagtggcttgatctcggctcactgcaacctctgcctcctgtgttcaagcgattctcctgtctcagcttcccaagtagctgggattacaggcacctgccaccatgcctggctagtttttatatttttagtagacacggggtttcaccatgctggccaggctgttctcaagctcttgacctcaagtgatctgcccaccttggcctcccaaagtgttgggattacaggcatgagtcactaacaggcgcctggcctgttatttatttttaaaaagccaaaagccagcttcctcctcctgccggctgaaccccacacagtctgtctgcacctgcctctccatcattcctccccttggctgcctctgttttgagcgctgagccctcttgccggacaggcctccccctcctccacattcctccaggaccaactctaggccatctcctcctcatatgcgtctgggatggctttgttctgtggcaactggttctcccggtgagttcctctgggctggttcctgtgccgcccttcctgtctgcgtgtggagtaagtcttgtcaggaccctgcattcctggtcagccagggctgggtctggcctttggagttccttcagttctcctgtagcaagtgcctgacgttgtatatgtgctaggtgccccaaatcatccactctgccagtccacaaatatttatcgaatgtctattatgtgtacattggtaattaaagcagacctttggagaagggaaggagccattagtcaactaattataaatgtaagctcctaagtatggtaaagtgtgagttgggagaaggacccagtgcactgagaccttccgttggggtgggatcagtcagtgtcagaggaggttccccaaggaagtgacacttgaactgaggccctagtagaagtcagcttgacagagaaggtgggaggagagttccaggccaagggagaggctcctgaggggcctctgtggagggcaggtgtggcaagtgggcaagactgaaggccagcgtggccggaagggaggatggggcacaagtgcctgggtggctgagggtggacggtgcaagtcagatcctgtggtgttttttgggcagtttcagccgaggaggttttgttttgatggaggagcagtggaacgatgttagagggaggcgctgtgcccatggggacagattgggagggcccaagcagtgggcagcgtgctgggaaaaaatcagctctcggaagaaatgccttgatccatagtgtgcagcagttctcatggagtagctactcccaccagggctgacttcaagccaccagtagtttaatagcccgctccggcctgattcctgagtagttaacaaccagctctcagtgactgctactacagtgtcactggctccgtcccagtgatgcaggcagaccaggtctgaatgttttggagtcgtctaggtgagagatggggagaggtgggcagacttaagagatatttagcctggtgcagtggctcatgcctgtaatcccagcactttgggagcagaggcaggtggatcacctgaggttgggagttcgagaccagcctgaccaacgtggagaaaccccgtctctactaaaaatacaaaattagccaggcatggtggcgcatgcctgtaataccaactactcaggaggctgaggcaggagaattacttgaacccaggaggtggaggttgcagtgagtcgagatcgtgctactgcactccagcctgggcaacaagagcgaaactctgtctgagaaaaaaaaaaagagagagagagatttaaggggtggaattaacagcgcttagtggtggagtagaggtggaggggagcaggaggagtggagtgcctgcaggtcctcaatgatgcctacccgtgagcccggcccaggccaggaagctctctaccttccttccccgtgggttctccccaagtttgggaaatctctagggctgctttgggtgctgaggagaagtctttgatcattgtccaagttcagaagatgagcgtgtatgttctctgttgggaacccctctgttcacagcctcttaaaagaagcagctgggctatggtggtgttggttccttgactctgatggttttactccacgtaacaacagtgtgcactttcctgacactccatgcactgcatcttgtctgcagaagaaggaatgttgtagttatcacaatagaagttacatgaaaaagcccctaagcatgggtatcctcagtcagagaagtggcctgataatcagaggcatcatttactgagaacctgctatgcgccagcatcaaactaggtatttacgtgctttctctccagccctcacaactctgaaaggaagtactgttgtctttgttcccattttatagttgaggagactgaagcacagtctctgtgactcacccacagacctgagctcgcaagcaaagaggctaggattggaacctgcgtctgttcggaacccaacctcatgctttttccattgtgcctgtggcttctctgtggtgaggactcagggggaggccttggtgttccttaggctctcattgttcaccacagtctaaacctttttgaagcaggaaggggaaaacacttctttattgattttttgttgtttgttttttgagacagggtctccctctgtcacccagactggagtgcagtggctcgatcagggctcactgtagccttgaactcccaggctcaaggagtcctcccacttcagcctcctgagtagctgggactacaggcgtgagacaccacgcctggctaatttttttatttttgtagagatgaggtctttctatgttgcccaggctggtctggaactcctgggctcaagcagtcctcctgccttggcctcccaaagtgctgggatttcaggcatgagccactgtgcttggttgaaaaacacttctttggaggacaaaacacttataagtcttccttgttagacagagaaccccacattgagtgtttcccagggagggagggcagtgaacaagcgagccccaccacaacctgcttcccctgttcttgtggttctcctgccacgcgggcctcaccattccacattgtgtcgggactccctaagacctccagcccaggggtcagcacaaaccacttcccagtaccgtttagataggctgatattttcaatgagacctttgttaaatacaaaggaagaggaggaggagataaccgagtgctcccacctggcagcatgttttgggagtgggggcgggaaacacgatactcagtcacacagacctgggttcagatcctggctctgtcagcgtcttggctgtgggtccccactttttgcatggattatggggattctccaatactgatctcctcagtgctgggtccccaacatggctgggcaggatgtgggtcagctaccttctggaagccacccagggtaccttgtgatatcatcatgttctgtgtacacttggctgtgaggagggccaggaagcgctgcctggggccctgcgggatgctcgttggggtggaggaggcagtgtgtgtactggctgttagaaggcagagtattaacgatcccttctatgaagcagcacggacctgtacttgtccctttatgggacaaggcaaagctttccacagcttatctgtgtgcttggaagccttaaagcctctgctccgttcagtcacttctctagggatttatagagcctgggcccgagctctgtcagggataccaggaaaaaagggtccctgcccttcgtgtgcttactctctgatcacagtgatccagggagcattcagaaatgcattaagtgagtctaaatccaagcaccgaactgcatggataacagtggctgccatttttccagggcatcatgtggcatctgagctgggttccctgtccgcatgatctctcccgaacgctggggaagggaggcttcttggggtgaatggagctttagcaggatctggaaaggaggtacactttcgagggcctggcaagaagacagaagccgactcaggtgggcagagcagcatctccacagggccagaaaaggaagtgaggctgcggtcgtttattcccggctccctgtggtcggatgctgtgtttcattttagctgacatccctggagtggatggagccatccccatcttatggatgaggacccagatgcttgtaccatgggcttctatcgcacctttaccaggcggtgggggagggagttacacctggacctgcttgtctcctgagcccgagtgcctggcttctgtgggtgaggcggcaggccactgtgccccttgggggtctgcactgtagggagtagggtgaagaagtcatggccctcttagcgtagaccaggcgatgctggggcccagggtctgtccagttacctgctgagccaggggtgaaactgcagctggatcccggacctttttggctcccagccctgggtcctcctgcccagtctctctggtcccagccctgcacctcctttctgaagcattcatttcagggggtggggtctgagaaggaggaggaggtttttactaattgcccccatgtccacagtggcctggttggatgcttgccatgataacgggacactgggctttctgcgctaagggtctaaacatggctcttggcctctgtgagtttcccctgagtcgctggaagaggcaaacttgaggaagctgggccccttttgtttctcctgtgactgggtcttcagctcgcatctgccaggcaccttttggtctgaggatgtgctccccctctgccttttttacaccttatgacacacatgcttatatataagttttatgtttacatgcatcaaaggcaaggaattgcaaactctgaggaccttcataatcactacattcaatctggacatacaggggaccctttctccgttttctcaaaatacagaccagttttttgttgttttgtgtgtgtttattttttgagacagggtctcactccagtagtccacgctggagtgcagcagcatgatcacagctcaacgcaggtctcgctctattgcccagccttgacttccgagggtcaggagattctcccacctcagcctcccaagtagctgggactacaggcatctactactatgcctggctagtttttaaaaatatttttagtagagacagagtcttgccatattgcccaggctggtctcaaacccccgggctctagcgatctacctgccttggtctcccaaagtgctgggattataggtgtgagccaccatgcccagccacaaagcagttttaagttttgtccttcacgaggagttcatataccagaagttgggtactgagatggcgcaggcctagtctgggtttccacagaactaagctaagactcagtagattccaggaaaaataaagtaagccatccttcttaccttacatgtgtttgagttccactgctagtgaagaacaaactccctggggtttcagaaccggtgatcgtagcctgcttctgttttaattgaattttgctttctagagcaggtatgtttttagtaacaaagtcattctgtttgcatttctgtttcaaatgaaacattactcatggaaaaactgggaatatttcggaatacttcctagaggcagatgaaggccactgtgttaggaaaagtttaagtatgtctgtatctacgcagaccttcctaggcccagggagttaggatttcgcctcaactctagggcgaagctgagctgtctgtgagtagaaagttagttttggtatctatgcccagttatttcaagacttgttcagtgttcacattgctgagttcagtctttttagtttgcatttggatatttaagaccaatatcaagtcttcagtatcagaatctcctcctgattctgggttgggccaagtgacagctgtgtatcaggtccagtgtttgtgttgggcaaaagactgcaattatccaatttgtagctagacagattacctaaaatcacttaataaactaagtcatctaatctattttttggatctgatgatctgtcctgtttcatttatgataggtagaataatcccccccaaccccaccaagaaatctggatcctaatccctgaacctatgactgggtggggcagcatggcaaagggaaattaaggttgcagatgaaattaagttttctaatcagctgaccttagagattggcctggcttccctgggggtcccagtgtaatcccaagggttcttaaacgtgggagaaggaggcagcagagccagggtcagccgatgcatgtgaggaagatggcgggacatggctgacacacggatgggctaaggggctacgagctgaagaaagtggcgcttctagaagatgcagaaggaaaagtagggaaacagactctcccctagagcctctggatggagcatagccccaccaacatcttagctcagggagacccacatcaggcttcagcagatagaactgcaaggaaataaagtgtgttattttaagccaccaagtttgtggtaatttattacggcagcaatagaaaacaagtgccctcttctgtgtattgaagttacgttgctgcagatttttcagtatcttggtttagtctcagtcattctaaggtaacgaaccataagttacagtctctttggctaaaccattgcttggaatagtgtccatggaaatgttgcagggtggatggaggtggatagatgctcttggcaatggcacctcacgctgcagcggggccatcggtctctgtttgtggaaccctgcgttccccacgtctgagctcctctgcaaactccgcctaactggaggcaagtgtctgtagcagtgtctcagtcggctcagtgctgctatcacagagtagctgagaatgggtaatttataatgattttatttctcatagtcctagaggctatgaagtccaaggtcaaggcatcatcatagggtgaaggcgaaagggcaagagacaaaagggaccaaacttgtccttttataaccatcagtcccacctgggatgcagagccattgtggccgaattgccccttaatactgaggtgatgtcctggcgcagtggctcacacctgtaatcccagcactttgggaggccgagacgggtggatcacgaggtcaggagatggagaccatcgtggctaacatggtgaaaccccatctctactaaaaatacaaaaaattagccgggcgtggtgatgggtgcctgtagtcccagctactagggaggctgaggcaggagaatggcgtgaacccgggaggcggagcttgcagtgagccgaggtcgtgccactgcactccagcctgggcaacaaagcgagactccgtctcaaaaaaaaaaaaaaaataccgaggtgatactgctacaacaggaattggctttcattgaattatggaaaactgtggaacttaagccatagcagatatcgtcaggcagagctgctgtggatgaagctaccacagaactgggcaaaaatgtgtctgagcactgtggggaagtgaaacctgaaagcaaattcacgtcagcctgagaacagaccaggaatcgggaggtacagggaggtgtaacatggtctgcacatcaattaaagaaacgttattcttttttttttttttttttttttgagacagagtctcactctgtcacccaggctggagtgcagtggcacgatctcggttcactgcaacctctgacaccagggttcaagcgattctcctgcctcagtctcccgagtagctaggattacaggcacccaccattgcacccagctaattttttatttttagtagagatggggtttcaccatgttggccaggctggtctcgaactcctgacctcaggtgatccacctgcctgggcctcccaaagtgctgggattacaggcatgagccaccgtggctggccagaaatgttattcttttgacacattccctaattcttgaaaagcttgagatggacttgtgtccaccatggtttgtaccactgtactaatcagtttaatagcaacaaggtggccgggtgcaggggcttaggcctgtaatcccagtgcttagagaggctgaggtaggaggaccacttgaggccaggagtttgagaccagcctgggcaacatagtgagactccgtctctacaaaaataaaataaaaataaaaaaaattagctggacacaatgacacatgcttgtaatcccagctacttgaagctgaggtgggaggatcgcttgagcccaggagttttaggcagcagtgagctatgatcactccactgcactgcagcctgggcaacagagtgagaccctgtctctaaaaagaaaaaatagcaacaggttttacaattgttgagagaggtcagctcttgttcagagagcgcctcagaatctaggccaaagatcagggttctactagacaaagagaatgagaaggatacttagggcagaacctggatgcccatgcctactgccgcagactggactgagggggtctcccatagtcacagacgtaagcctgtggctgcaccatgggtgagccttggaaacagtgctcagggaaagaagcctgtcacaaaaggccacatgatatatgattccatttatatgaaatgtccaggacaggctaatccgtagagacagaaagaggtgggtggttgcctaggactagaggggctcggggagtagggagtggctgctgatgggtgtggagttttgttgtgggatggcagacatgttctaaagtgtgccgtggttttggtctcacaactcttgagtatgccagaaactattgaactgtgtaatttaattggatgaattgtatggtgcatgaattattctcaatagagctgttaaaaaaaagtaggcatgcaaggtcaccatctgatggaaagcttagccaaagtggtattgggctttgatgaaagcagcttctgagagtattttagaagtgttgacagtacctcctttctggcatggagtctgctgttccatttccacctttttttctgaagcttttggttcttggtgtcggtgttaaggattggtttattggtcagtgactcagtggtcttattagacagcttctggtgtatgtggaggtttccatttttccttttcttgctgtgaaggtccttgttcctgcagggatcctggccagtttggtaactgtgagactgaggtggcttgagtgccatgggaacagccacactgggaggccttgccacagtcctctgtgtgtctttttttgtttttgtttttgtttttgttttgaaacagggtcttactctgttgcccagatctcctgcaacctctgcctcttgggcttaagcaatcctcccacctcagcctcctgagtggctaagactacaggtgcatggcaccacacctggctaatttatgcatttttttgtagagatggggttttgccacgttgcccaggctgatctgtgtgtctttttaagtcccattcagtaccatgtctgttgctcacttacaagatttatgattcttttcagtttgcatcttcataaactgagaaaacagaaattggcctaacagggcctctaggacatccttcaagtgagccacagtagagtctggtacaatgctgaaatcttctcctactgctgggtgccctgtgccaccctgcaggtgtggctcttgcccaggtgtgtgtgcgggtagggagtttcgtgctgtaggtacacaggaggtgcaggatgttggtgcaggtcagcttgtttagcagtggcaggatcggctctcaggctggggctccgggagctgctgccttgggcagctgctgccccgcagttgtcttggagacccccccatagccaaaagaggtgacagtggtgcagtggtgactcccttgtggcagctggagtgcccgaggccagagccgctttccctgctgcccgtgccacagcctcagggcctgcccgtctccagtgtccccactcatgcaccagggagaagaggggaggccgccaggagccagtggctcagctcatgattcaccaggtggaggagccaccgctgaggatgctgctggttacctcgatagaggttaaagcccatgaagatggacaagtctataatttaacaaagagaagagaaaacagcctgttactctgcagaaagtaactctttggcatgtgcactgaaggaattacctgttacaggagtatagcagagggtgagaccctcttgagctcggcagaccgtggtgcccatgcacctgtgctggcaagtgtagcagagcagggccaagcgccagggtgggtggggccgtctggctgtagtgtcgtgggaagagtggctggaaatgcagataggagccaatctctgtaggatgttaaacaggagtactcggatgacctgggttccctgctctgcagggttactaatacctgctagaggcttgttttcaagccctgaaagatgggtgtcagtattcccattttacagaagaaactgagtcagaccaagtggtttacccaaggtcacacagctagtaaatggcacagttggaatttgaaccagccagtgtttcatctgctatattatgccatattatgcttgcgttctctctgaaaggacaaaactctcacatgaaacaatgaagacactcaatgtggtgttcactattaggttgaaccacatgcaggtgccatttttgtaggtcaatgtggtcaattatcagcagtgtcccatgggtcagcctaatacagcagcagccggggttcggacagggaaacctctctgcgcaggaatggtcagtagaggtttcatggcggagctgggaatggagcagggccttgaaggctctgtagactctggatggatagaaatgaggtgggagaggctgggtgcggtggctcacgtctgtaatcccagcacattgagagtgcgaggcgggcagatcacttgaggtcaggaattcaagactagcctcaccaacatggtgaaaccccgtctctactaaaaatacaaaaatttgccaggtgtggttgcgcatgcctgtaatcccagctactcaggaggctgaggcacaagaatcacttgaacacgggaggtggagtttgcagtgagctgagattgtgccagtgcacttcagcttgggcgacagagcaagactccatctcaaacaaaaaaaaaaaaagagagagaaagaaatgaggctggagaggttgggtgagaggtggagtggtaaggagacagcccaaagggcaggtgctacgtggctgtcgatcagggtgtacatgtgaccttggagcaccaggaggtgattgcaggtaacgcttggggcctggagacccctcccatgcagcagacagggtgggatttggcctgcagctcgctctgctggtccccactgtgctgtttctgtaggaaacaggtgagcagattgccatcaagcagtgccggcaggagctcagcccccggaaccgagagcggtggtgcctggagatccagatcatgagaaggtgagggcctcgcgcatagggacccaagggaaagctggagcagcagcccccggtgtgtctagaaaggagagtcttgctgggtgcgtggctcacgcctgtaatcctagcactttggaaggccaaggcgggcagatcacgaggtcaggagactgagaccatcctggctaacatggtgaaaccccgtctctactaaaaatacaaaaaattagccgggcatgggtgggcgcctgtagtcccagctacagagaacaccagggaagggggaagggcatgctgcacactctgctgggattactccaatgacaaggaaaccccgtctctactaaaaatacaaaaaattagccgggcatggtggcgggcgctgtagtctcagccgctcgggtggctgaggcaggagaatggcgtgaacccaggaggcggagcttgcagtgagccgagatcaagccactgcactccagcctgggcaacagagcgagactccgtctaaaaaaaagagaagagagtcttaaatatctgcccctccatcagggcgccagcctggcagtctccacggtgactctgctgcttctaaagacaccagaggaagagcagctaaagtccacactgggccttgtcaagggctgttcatcaatttcattgtattaaataagttaacacagttatcacagtgacttttcttttgtcagcaaaaaaagccttctttcctcctatatttccagttccaaggtggtatgtgaccgttctctgctgtcatgctgtcgctgacatttattcctctagtgtggagacggggctgtccatctgcctggtggctgctgaccccctagctagtgaggcgtgaggtgggctccgaaagagccagtgaggaggacaccaagcaggggctcctctgccagcctcttaaaaagaggaggtgctatttggttatgtcatggttccatttggttacatgagttccttctcagacccttctctgtgtgtccaccttggggtgatgtgtgtgcgtgaaccaacctgccgaaaattaaacagacaaaagaaaaaaaatatgaaaacaaaaagagcaggcaccaccttgtttgcctgcttgcgtgtgtgacacatcctccccatgtggagggcatgagattgaaaggtccttgtaggagcagtttggcagcacgatgaggacttgggatgtggcacgcacaaaaaactgaagttacacgcagttgtgccctcagggtctgagttctggtgctgtgagtggggctgggtgagcgccactgacccaggcattgcggttggccacccgtcctgggctctgtcttcctctgtttcaaagccctgggttatcctgggcctttgttgctgagacctggtgggggtggtggggatgggtctgggcaggagcctgggtctgctctcatcggttttcctcctcctaggctgacccaccccaatgtggtggctgcccgagatgtccctgaggggatgcagaacttggcgcccaatgacctgcccctgctggccatggagtactgccaaggaggagatctccggaaggtgaggctcccacggctgccaggtgcacagcctgtctgggcaggtgggacaccaggaagagggatggggagacctttcacttctgtcatcatcaggaagcttggggagccccagtgactccagcagggctgctttgcctctcagatcctctgttccctgcccacctggggctggtgtgtgtgtgagtcagaggcgcttccgagaacaccagggaaggggtaagggcgtgctgcacactctgctgggattactccaatgacaaggaaaactcatcacaggtctgggcgtggggaaggactgggcaagttccaaaacaaatgcttcctccctgggcatgttagggccacgttaggcctttggtgccagtgccactgctctccttattaggagggattttattctagagatgggacagcaccacacacgggggcagggagcatagcagagagggagcaggattcatgatcagagagccgggccagggctgcagacccgccccaatccatccgatccacctgacccacctggactcatctgtggggctctattctccaccttctcaccacaccacctcctcttccctagaatgttcacttctggtgggtggatggcagcccctcctggtctcaggggcagttgggtgccctcctccccattgttccctatgacagtaccacacagcctgctagtacatgttacctcattcgatttccaaaagctcacacatgggtgcacaggtatggttcccacatgatgggtggatgtcatggcccagagaggttgggcctcacacagctgtagcagcagagcctgggtcccagcccacacagacccagctgcaggccacctctccatctctgaggctgaataaggccatataacattatgaaaactggaagctctgaacaaaataatttttttttttgagacaagagtctcgctgtattgcccaggctggagtgcagtggcgtgatctcggctcactgtaacctccatctcctgggtccacgtgattctcctgcctcaccctcccgagtagctgggattataggcgcccgcccccacgcctggctaatttttgtatttttagtagaggcagggtttcgccacatcagccaggctggtctccaactcctgacttcaaatgatcacccacctcaggctcccaaagtgctgggattacaggtgtgagccactgcgcccagccaacaacaatttttattttaattgaaaaagaggtcggttgctctgcgagtgcacctcttcactccagaagggtcacaatagtgggggcgggagcccaggcgtttattcctgttcagtggccattcccagacacacttcaggtgctgttctcactgttcctccaggcccttgtgcctcttaaaaaaaaatttttttttccactttggaaagctgagacaggagaatagcttgaggccaggagtttgagaccagcctgggcaacataccaaggccctgtctcctcaaaaaataaaaaatgaaaaattagccagatgtggtggtgtgcgcttgtggtccctactactttggaggctggggtgggaggatggcttaagcctgggaggttgaggctacggtgagctatgattgtgccactgcatgccagcctgggtgacagagcaagactcagtctcaagaaaaaagataatcctgtctcagaacaaagagacagataaataaaataaaagaaactttccatggggcttggcgtgctggagtggctctccctggagataggcatgtcctgggagtggcactcacagcaggatatgaacacagcccttggcatcacccacaatgagagatgggggaactcaacagcacttcgattttctccttatttttctaacctttgacagtcacccattactaactgcagctgtgtagagataaagccatgttgtagtcaagtggagacttctcagagggcagtctggaagtaggtgggatgtggccagattacagagggctctgaagtgaggcagaggcttttagacttggtcttttaggtggcaaagagccaacgagccagggaagaagagatcgaaagtttaacatgactggcctggcgtgggttgcaggatgattgagggggaggcaggaagggctcgcatcctaagggacccctgtccttgctgtcacccagcggggttgggggaggacactgttgcccagtgtcttgttatgtgttgtttcctttgttccctctaaaaagttcaaatctataatacacccgtgggcatggagaggcaggcttggccagcacatggggacatgtaagagtcgatgttaaaagtctacatgctgggtacgtaaacagatgagtgtttatgaatatgacgtgaattccaatggtgaggctcagatgggaagctcctctctccgccctcctcggaggccagctcccagcagcacacagagcctcttgacagtcgagggggccaggaaggcaggggattaagggcttgggcttgagtttcagattgacctggcgccgcattccagcactgccctctcacagctgtgtgagctgacaggtatccgaccgtgtaacctcagtttcctcctccaacacggggattccacccgtacttactcagtggtggtggttagtattaaatgaggtcacgcagggaaggctttgctgagctaatctgtgcagagctcttccggcccctggcacgtagtaagtgctcagtaactgttctctactgttaccatcacccacatggctaggagatggcagggcggtggtcggagggtggtatccagtcatgccctcccagcctggcccgtctctaggactctcatgcacagagaattcctatttcctgtgcttagacttcagcctgccttgctcagaactgcagcagctggtgagaatcaaactttactcacctcagaggccccttgctgtgaggatgtgagagccctggggtggtcaggactgcttcctctttctcctcctcctcctcctccggccaatccctgctagttctgcagccctggcttcctcaaaagcaggtcccctaaagaccagggcccagggtcagcactctggtcacatgggctggtaagagacatgtgtggatttccggtggtttgtgaccaccagctctgatgctgcttttcactttcttgacagtacctgaaccagtttgagaactgctgtggtctgcgggaaggtgccatcctcaccttgctgagtgacattggtaaatcccagtcccggaattcaggccgtgtccttcagggagagtgtggtgcccctgtgagtccctgcggagccctgcaggcagacacttcaatcctttggtctctgtggaaggggaatgggagcccagggacgggggaccctggtggagtagggaggtcaacaaggagtcagccagacagatgctgaactcaaataggtttcccttccttcctgattaactcatcaggtgaattatgatgtatagggaataacagatttcctttcccattataaagctcccctccctcctttcctggaatggccggcgctggaataagttgtcattcgaatgagttttgtcccttggcagtgaatttttccgctcccacgtaggcagttctttgccaatgagaggcgtaggaaaaactgtcctttttaatcccttgggtactgttggcttccccaaatgagggcatctgcggcaccctctgagaaggccaagctggccattcatggagaagagtgacctcagcctgcagaggtcagtggagcctcctagaccctggcgctcactcaggaggggtctgagggctgggcgctaaaggtcagcacctggccccagcctggggagacagggagagggacttgctcagagctttttgttttttttaaaaaataatctccagggttgttggtgcaagttgatagttggggtctaaggtttagagttatcagaatttatctttgactctttgcctccagatttggagaatgatgccattttcatccctccactacctcaacctttcaaagctgtatacattttttctttttgtttgctcaagtttttttggaaaattgtcaaatatatagaaaagttaaaagagtagtacagcaaaactcacataccgttcccctcggttcaccagatgttaacattctccctcatttgtaaagctgtcttctctaagccagggcctggaagggttgatggtccaacactgtcttgctagtgtgggtctggtctcttcctgactgctgcttttgacagaggagaagcaagaaggaaaggaaggggaaaagtcaagcaatgacatatttaaggttaagatccaaatagtctgacacagaaaattcccatcttgctctgtgctgtgtcttcgtccctttgggtggagttcacatggaggatacgttgacattacatcagttttatttgactcgaatgagcacccagtgctggcccaagggatcccctgcacatggcccgcatgagtctcttctctgtctacctagagcataatccatcagttagaaattccacttgttttcttgacaccctgacccaaggctcacccatccatgttttgcttggaggcttacttgattgtattttttacctcagtggccagattcttcatttgttctctgttgaattgggttgaaggcaggttagcaggttggggagtattctcttgcttttcttgggtgatttttattttgtttctctttggttaaagctttgtcaagttattattttttttttggatgtttttctctcagatatttttctttcactccttaggctgttgatgactttagcaagtagttattacgaaagtcttttttttttttttttttttgagatgatggcttactctgttgcccaggctggtgttgcagtaggcgacctcagctcactgcaacctctgcctcctgggtccaagcgattctcctccatgagcctcctgagtagctgggattacaggagcacaccaccacacctggctaattgttgtatttttagtagagacagggtttcatcatgttggccaggatggtctcgaactcttgacctcaagtgatctgcccatctcagcttcccaaagtgccgagattacaggcatgagccacagcacctggccaaaagtctttaaattattggcacaagtgccgggcgcagtggctcacgcctgcaatcccagcactttggggggctgatgcgggtggatcacaaggtcaggagttcaagaccagcctgaccgagatgctgaaaccccatctctaccaaaaacacaaaaattagctgggcatggtgacgggcgcctgtaatcccagctactcgggaggctgaggcagaaaactgcttgaacccaggaggcggagaggttgcagtaagccgagattgcaccattgcactcccgcctggtgacagagtgagactccatcttgaaaaaaaaaaaaattattggcacaagtgcacataactctcagcttcctcatatggttgtttattctgcaggtgttttgctgctgatattcacagaacctctctggttacgtattcttttggtctgggtccactttgaattcagttactattgacttgtgtggtagcttttatattattttattcaaattgtgtgcatgtatgtatttaagttacacataaattagaataatgaaaacaggtgcttcttcttaagtgcttgtgtgctataggtctcctatagatagataggtaggtgaatattaaattctgtaggttgctgattctctgtctgtcttctctgtgaccctgagttggaaataatttgactttgaagtactaactagtacactacagttaaacttcttgagggcacaaacttcagtcactgcttatcttcagcatctagaatagcagtatataatcttctctataaatatttgtcaaatgagagctggatgcggtggctcacgcctgtaatcccagcactttgggaggcggaagcggacggatcacctgaggtcaggagtttgagactagcctgactaacatggagaaaccccatctgtactaaaaatactaaattaggccagacgcggtggctcacgcctataatcccagcactttgggaggccgaggtgggcagatcacgaggtccggagttcgaggccagcctggccaacatggtgaaaccccgtctctactaaacgtacaaaaaacccaaaaaactaaaaactaaattagccaggtgtggggcatgcctgtaatcccagctactcggggggctgaggcaggagaatcacttgaacccaggaggcagaggttgcagtgagccaagatcgcaccattgcactccagcctgggcaacaagagtgaaactccatctcaaaaaaaaaaaaaaattgtcaaatgaatcaaataaatcctaaaggaaattaaaataagtaaggacctagtttttttttaaaatcaaatgtccacacatcatgaacagctccaggtccaatactggctcctttgcttattagcagtgtgaccgtgggcacgttacttacacccttttattagcggtaaaatgggagcgttactcaccttgttagaattatggaataaaatgaggtgatataaataaagctcctagcacaatgctctgttcctgcagaatgtgcagtcagcaagtgttagttccttgctcatttccttcccgctctggattttgatttttggcctctccttttggaaaccttcagtgccttctttagggcatgacctgaggctggatccagggaaccacacgggtgggtgccttctgagactcccatcctggaagaggccagccttcctcagacctgttcacatctccgccaccttttgggtgcagtgcagccccggttttgtttttgaggctgctgatgagctcgtattttacttttatccctgtttctgatttgtattctaaatccattaaatttctttttgcaaggatctggtgactgagccggagttcatctaacatagctcttttgtattttggaacatttcctgagcatattttgttccagtttgttccaagtgctggcctcacatttcctttgttggagttgccactgctgttctctgccaggttgacttcagataagtggcagagccacacccttgaccgctgggtccggattcattgccttttcttctggattaaactgttggcccctactctcttctgtgccgctaacctcccagagacacccgctcagaacagtgtcaagataacagacatggataggatttttccactgaatttcaaattgcccaagaagaggctgcagagtgcctgtgagaaatgagcagatggccaggcgcggtggctcatgcctagaatctcagcactgtgggaggctgaggcagatggatcacctgaggtcaaaagtttgagaccagcctggccaacatggtgaaaccccatctctactaaaaatacaaaaattatctgggcgtggtggcgtgtgcctgtagtcccagctactcaggagactgaggcaggagaatcacttgaacccgggaggcagaggttgcagtgagccgagatcgcgccattgcactccagcctggcaacaagagcgagactctgtctcaaaaaaaaaagaaaaaagaatgagcagctgcctggcgggcacagaggtgagccccctgcatcctggccaggactcttctgccagaccatcactccatgctgataggagacctgggacccatgtggagcagctggaaatgatatggactgccacgtaatgtgaccctaaaatagctcaaggaagttatatgtgagtggactctatttaaacagtcttgctcattatcctttggaaaacattggcatgtgttttcttttgtcaagggaggctcaaaattctgggcactcaagattgcagggcaggctgtggtgctctctcctgcctgatggggtgtggctctgctgggcgggcctgggtcttatcagatcttagattggaatcagcctttcctggattctgcaggtggccagtctgctgtggtgacaccatcctgtgctccaggcctttcgggaacccacccctctgttgctgtccctgcttccttctcgagctgctcctagcaggcatccaggacttcagcgttaaagaacagagggtttcagagaaaacatttggctttggggaagagagctccattccaggaactgcacatcaggtgcactgtctagcattgtggatcttctgactggttccattgcatgcatccatctgactgaagtgtggattatagcaaaagatcatttgcacataaagctttttggaaagcataagtaaccaggttaataaatacagtaacaatgagagagaagacagcaggccctcagtcatggctccaccattttatagctctagagccttgggcgaggcatggaatgtcatggccgcagcgtccccttctttaggatgaggggtttggacctccgagtgctctctagggccccgtctccctctaacaactccatttcactgtccagaaatctggttttcaggatggtggccccgggacatctctgacatccgccagctggtggcctaactgcttcccacaggctctgtgtctcatctccactgcctgcccctgcattcgcctgtccgtccttccctccctgcccctgcgctggctgcccgctgctcctcgacgttctgtttccctggccgttcttgtggcctgtttctcaccatattgttcccagaatctggaattcaaccctgaactcatcctaaagtcatatccatgtctgccaggtctttcttccaaagtcaattccagtagaagctctggttgtcttcttcagccaggtccctcctgccatcccctttcttgtgtcatggtgccactttctgcccgctgcccaggaccaagtgtccgtgtcgaacctggtctcacagagtcagcccccgctcctgctcatagccttgcattacggaggctgcagaccgctgcttctgctgattcaatgtcagagcaaatccctgcagcgacctcctccctggcctccttaaccctgtgtgctaacctacccttctgtcttggaagggcacttccatcacagtccactcttagataaaggcccagccccttcgccgtacctttctcccactcagccctgggcatgacccacaggacccacccgccaacctctgtgtgtgacccttggaacccacccgccagcctccaggcgtgaccctcagaacccacccgccaatctctgtgtatgacccacagaacccacctgccagcctctgtgtgtgacccgcagaacccacctgccagcttctgggcatgatcctcggaacccacctgccaacctctgcacgtgacccacagaacctacccgccagcctccgtgcgtgattccaaacccacctgtcccttgctggccttgcacgcgttgccccttgtggaagctgttcttgcacctcccagagaccctgagcctgcccgtcctttgggcacagctgcagacctgcccctctgtggggattgcctggcctggggtcacggggattttcctgtgggtctttctgctgatgtcacctcatttgctcctttgacgcttggcattgccattactgctctgtgatttctgtctgtgccttggcagtgagggctgacttccgggtttggggccagttgaccagactgtgcaggaagttaggaaaaggctttgattcagtggcatgtttcccattgtgtgcagatagtggacactcaatagagcctcgctgagtgaattagtgaagttgtcgcactttcgccttggcacccaacgttactgccttgctgcctcactgattaattgaaggctattttagccaagtaacctttagccagactcagtctctctccccatgtccacagctggccttcaagtctgttttttttgggaagcccagtgacattgaagtggctggcacagtaggacccaggcagtaggttttactgagggaacggacatcctgttgcctttctcactcagtgatgacttggattaccagccagttgacaaccaaccatctttgtacccttctaacctctatctcagccttttggaccatttctctttccacctgttctctatggaatgtagctcaaacaaaaatgttctgaagggaacttagtcatccctctaaacttgtgatagatagagattcatggacccacccttataaaactgctttcttctcggaagtcttgctgctcttatctgttccccagtttgtggtttgtcatctgaaaaaaatacatagggctgtggggctgtgattcggagctgtgattcatcaataagacccacaggattgtcagcgttcttcagttatgtgtttgtgccttcctcatgagccagggaaaggctggggttaccaccggggcacggcttctgaggagggtgagagaaggaggctgttatcttcctatggcaagtctgccatgtggacccattctgtggaaatgtactgtgtcatttatcttagtttttgtgtttttcctgcatacactgcactgtgtcgtttattttagtttttgcatttttctagaggcagggtcttgctctgttgtccgggctagagtgcagtggcacgatcatgtttcaccgcagccttgaattcctgggctcaagtgatcctctcacctcagtctcccacgtagctgggatgaaggcatgcgccaccatgcctggctaattaaaatttttttttttgtagagacagggtcttgctatattgcccaggctggtctcaaactcttggcctcaagggatcctcctccctcggcctccgaaagtgctgggattacaggtgtgagccaccatgcctggcctcactgtgtagttgtgaatagcttaatagtttgcaatgtggtgcttctcacagctcttctctgtaatgggaacatgaaaaattacctggtacagttttatgctttgtggtgtggcttttaatttttataaacatgtcttactgctattgccagggatttagatttttaataaacttccagattcaacagtatttttcttcatctcaatgtctcatttttcatcaaatttaaacaaagttagattctctgggcttgaaacaattttgattcatttcactttagctctgaagtactgttttgtaaaatgtagcacagtgatactgaaccaagctttttgaaagcttattctctgcagggtacatttaagaggacttgcctatcagaatttttacatttcagtcccagaaactatgtgtaacaatacctgttggattctttaaatctggactttattaagttgacagaggtattgaagaatagatgaccaccccgaaatgaggaataaagtttgttttgtacagttgtttaagcataaaaatagacagatattaatagtagtcagagtattcagttaccaacctcttgtccctcctcactgaagatctggtgacaactctaatccacgtggcgtagagagcggtgcctttggtctaatccgaatgctcctcctcttcactggggggttctggggacatctcacctggttgtgccctgggttttgccctgagatgttagcctccagctctgggggccttgtctcagtctgggcatgtgtacttgctcaaattacagtatctcaacttccatatattctgctttggaaaaaactaacctacacttttatgtattacatcctgatactctccagcagtctgtcatataccaaaacaggtcttttgtgaacctatcagttaacagacactttgagttattgcatggccttgctctctgccagccagtagttcatattcaacagcagtgccatccctgtctgcaaggctgtgttagtgcagctattttttatacttcatttaatttattatgctttttcatttgctttgatttttaataaaagtaaaacaaaaataaaagtgctgatgagaagcattggtcttgaaacattaacacaattgagaacaagatgaaatataattttttaggcacatggaaagcagcgagtctttcacctcatctggacattaattggacctaagctgatctactctgtcacttaggaaggaaatgaaaagtaaggaacagtatgatatgttggaaccacatggtcgaaggctggacttaaaagagcagatgcaaggagagatctggcaccacagatagagcatccctaatcccaaagtccaaaatctaaagggctgtaaaatctgaaggtttttgtacactgacatgatgccagaagtggaaaattccacacttaagtacttaacacattgttccatgcacaaaattattaagactattgtataaaattaccatcagactataaaatcatttataaaaattcagttgtttcatataaggtatatatgaaacaaatgaattttgtgtttaagcttgggttcattaggaatatgccagtattccaaaatccaaaaaaaaaaaaactgatcccaagcattttggataagagatactcatcatgtatagcttaatgttctgagctggaactcctttaataaggtggaagtcagttgttcagctctcagtttgactcttaaatatgttttcagcaaatgttcagcttagagtctttgcagagaatgtttgcttactcagtttctgtggaaggcttttccgttaccctgcacagagggccgtacccatgacagcagataggatcgctgcctgggcctcaggggtcttcccctccccggcttgccgagagggagagagagagagagagagagagagagagaatgagagagagagagagagagagagagaatgagagagagagagagaggagagagaatgagagagagaatgagagagaaacagagagaatgagaatggtggtggcggcgacggcatacagagggttcattgttaaacctctgaatgttactgcttttgactttttaagttttaaacaagaaacaggtcataccattaactatccctctgagtcagaaaatatagacccaagagttgcctgttctaatgtggcactaccataatttgttctaacatttcctaatgactgtctgtttctaattatttcattcaagatatgcagtaagtatccttgggctaccagtgaagtgataccatttgtatctcttcttctgtgctttctcaccacttgacattctttgcccatttttctttttctttttctttttttttttaggtagagtcttactctgtcacccaggttggagtgcagtggccatgatctcggctcactgcaacctctgcctcctgggttcaagcaattctcctgcctcagcctcccgagtagctgggattacaggggcatgccaccacacccagctaatttttttgtatttttagtagatacagggtctcaccatgttggccaagctggtcttgaactcctgacctcaggtgattcgcccacgttggcctcccaaagtgttgggattacaggcgtgagccaccgcgcccagccccatttttcttctgcattgctttcttattgatttataagagctttttatctattaggtatctttactctttggtgtatgtgttgtagatattgtttccccacctctcttatcttttggctttgtttatagtatcttttgccataaactttgaaaaccttttaatgttatttgcactgttctatttataccatgtgactttcctgcatacactgctctttttgctacatgtatcccatggtgttttggagtttttgttgctaatgtgaatgggattttttttcctttccactgcaactggatatagctaacatagagaaaagctattgacttgtgtattcttgttcgtttccagacaactggctaaattttatccagtgtttagtctgttgagctctctaggctacatctccaaatctatctccatctctagtcatagcatctccaaataaaaataattttatctcatttcagtactatttatttcatttctttcttttatagtgcagtgaactagatgtctgtcaaagttattcaccctctcttgagggtaaaatcatgtccttcttgccatctgagctgcaggcgggtgcctcctcatgtgacatcatcacgttgcctcctcacagcagaagctcttggtatcaaatgcttccgtagccagtgttgtgcagtctgctttcttccaactagattctgagctctttaaagttggggatcatgccccttattttatgtccctcacagaacctcccagagaactgggcatgtagtaagtctgtgtagggctgtctgtatgtgtgggaggtgtccctgttctcctcttctgcctccccgctgcttcctggaagccagttctgacctcttgggactgtcgatcatatgaccataggactctgtccccaagggcccttcctccttgcccaccctatagaatttagatttttgagcctctagaccaaagaaacttcccttctcaaaactttattggcgtcagcatcacctggagagtttgttaacacagatcgtggggtcatccccagagacttgaatccagaggtctcaggtggagcccgagaatttcacattttgaacaagcttgtttgctgctggtccaggtagtatagtttgagaagcactgctctaggctgcagttggtgacctcatggatgcaaggcaaagagtgctttgcgcaagtaagccagattcctgtggaagtttaagcctcacgtagcagggcccctgccctccaccctgaggtattgcgctacaagtcagagtatgtttcaggggcatgcggcatttatcttttgcaggataggagattctgtcatgaaaagcattttttaggcctaagaaaaactcacccccctcttcctcagcctctgcgcttagataccttcatgaaaacagaatcatccatcgggatctaaagccagaaaacatcgtcctgcagcaaggagaacagagggtaagtgacctcctgggactgggaaagcctcaggtgggcgtgccgggaagtggcctgggaggaaaggagcacactctgcatatttgtgtgtatttgcatttccttgcctgtgctttgattctctgggaatgctgtttgatttgaaacaaaattgagcaaaaaagttgttgcagattgaggcaagtttaaatggattacattgttagttgctcaagttgcaggaatctgataaggaaaataatgtttgccttcctacctccacccctagcctctgggactagcgcttcttggaagtcgactttttgttttccatttgctttaagagcctcgcctctcgactctaaatggaaaccagtggtcagttggttgtggatgtggctgggaagaggcactgggagctggcctctgctgccaagcctggtccagcctatagtttccccagagctctttgtggcctcctcagtggccacccggctcagacgtggtgttgactgccccacaagcttgacattgtggtctttacccacccactctatgtgttcagctggggtggtgagcacaggctcagctgagtggaatacagtgaatgagttcttagatcacctaatcccttcccatacagctgcccttagcacctaggcctggcctgtgactaccacagggctcgcccttgttccagttcaccctcactcctgtcagtggtgctcagatttgagaactgagggcatttactgagaagaggctggcccggtccttcctgtttcaagtctgggtttagctgtcttgagggctggtgcctgttctgttcattcagcttccctctgatgatgcgtggcagagtgtgggaggacacgtgcctagcatttttacaatatgccttttcttttagccctgaatctaccgtgtcgagggcattcttttgtgtatctggtggctcttaggagtttgggatctaatagtacctgggaattcagaaatacctctgctctaacaccaggcagtcagaatcctcgtagaaggacattgtgttcttataaccctcagctttctccttccttttgttttagttaatacacaaaattattgacctaggatatgccaaggagctggatcagggcagtctttgcacatcattcgtggggaccctgcagtacctggtaagaagtgggccttgcctgtttgcctgtcagctcctccctgctgctgcatttgtggggctcctgtcctgccttgctcccagcacctgagtcccaccggctctctgaatgttttggagatgcatgaggtcacacccataacctggtcgagtcagcattttttgccaccagatgccctgtggagggatgtggtcgtcttctctgatgtccggagggctctgctcatgcgccttgcaccatcccctagcctctctgtgcttcagtgtcttctctgaaaggaaagggttttaaacagatccatgctggtcttgagcggtcctcccacctcagcctcctgagcagctaggactacaggcaggagccactgagcctggccgaggccacactttccatgaggtatttcaggggccactgagtaggggtcagagctctgagctccccaccctttgtttacgttatttggtctgaatattaggtttctgtttgagtcactcattcattcaagcatattgatggagtgtagtctgtgtcaggcactgtgctcagggctggtgatgcagtggggaaaaaagacaagcccttttcggccttcagagcttagggtttagcaggaaagcaagcattactgtgatgcttacacagataactaagaaattacagttgtggtgagtgttacaaagcaagagtgcagggtgttgcaagaatatatattgggtggcctcagcctggtctgggacttgaagggtaaggaggtgaaaagggctggaggtgggggacggcagggggaattccgtgcaaagggatcacacacaggaagacctgcaggtgtggctggaaccgagcacaaaagggaaagagagtcttgagttgaagctgagaacaaggtagagcacagattatgaagggccttcagggctgggctaaagttctagactttatcttaaaacctctgcagagattgatgggttttaagtgggagaaggagcaactctttggaaagcccactcctgacactgtgtggagaaggaatcacactgaacaggagggaaaagtgggtgaggtaggggcagtgaagatgtagagggcaattagattccaggagggcttagcacaaatgcccagcaagacttgtcataggttgcttgatgatggcagtagccaccacaattgggagtgactcaaggagtctgcggctttcagagtgggtctcacagagggctgtgattcaggcgcctgtgtccatatggcatgtgatttggtagatccttctggagtcctcctcagctcagcagcagtcgagcaagggggaccccatgctctaaccaggagctgagtcaagtcatgtactcacatgagctaaaacttctgcccataaccagacatagaggttgacctacccatcccggaatgtcttctcttggtttggtctcccgggcccttccttaagcttcacatttccaaccagaccatgcaccaccctgtctctgtgcttttgcttgccccagtcatttctgtctccacccacctgctaagcccagtctgcacccccagcaccccgtgctgccgccccttcttcggtcaccccagcgctctctgcctcagcagcagccatgcatcacactttccctgcctgtttctaaatatcctggccctttctgcaaccacatggtacctggttcaggggttcaaccagcacttaatgcgtgtatttggtgtggacagcctggcatcattttcctttaacatttgtagcctctcttcccatttctacacagtgcccacgactgtgtcctgccttaagctagttttcaataagcgcctgaaatgctgcaaccctttttttttttttccttttttttctttctttctttcttttttttttttagacagagtctcactctgttgcccaggctggagtgcagtggcatgatcttggctcactgcaacctccacttcccaggttcaagcgattcttgtgcctcagcctcctgaatagctgggactaaaggtgcacaccaccatgcccagctaatttttgtatttttagtagagacggggtttcaccatgttggccaggctggtctcaaactcctgacctcaagtaatgcgcctacctcggcctcccaaagtgctgggattacacgtgtgagccactgcgtccagcctgcaaccctcagttttaaaggagagaagttaaagcctagcgatgggtgtgtgatgtactctggccctgaatctttagcccctccatcagtacctactggagtgagtgggacatagaaaggtcttagaaatggtagcatgatatacccgctaaacatgcctggggtgccctcctcgccctgcatgcatgtgccagtgccctctaggatgaagccaggggtgaaagcagatgggctggccgccccctcctgccgtggtccccccagagaggagcagctcaggtgtaccccctcctgttgctgcaggccccagagctactggagcagcagaagtacacagtgaccgtcgactactggagcttcggcaccctggcctttgagtgcatcacgggcttccggcccttcctccccaactggcagcccgtgcagtggtgagtgggcccggggcacctggatggaggagggagcctgtctgttcctttctcttcacgtaccctgtttccctggcgccccatcaccgggcctgggagatctgtgttgtttctcttccgagaggaaggcctgtcaggacctagcacgagtaggggagtggtctgtgctccaaggacctgttaatagatagagtagctgttaagtcttcatgtggattctgagccttcacatctttaaatacaatgctgtgtcagtgtcatctgctctgtgttcagaagtaagactattgtatgaatatacgcacttacactgagaatgctgtgtgttagtaaacaaataaaacacgtgtacacatgacaagtcaggaggaaatatgtgaaaatttgttgttgacaaatgttactacaacctgaatataaatttttgtttttaaagcgtaagaatgtggccgggtacagtggctcactcctgtaatcccagcactttgggaggccgaggcaggtggatcagttgaggccagcagttccagaccagcctggccaacatggcaaaaccctgtctctactaaaaaccctagccaggtgtggtggcgggcgcctgtaatcccagctactcggaaggctgaggtgggagaattgcttaaacccaggaggcagaggtcgcatcactgcaatccagcctgggcgacagagtgagactctgtctcaaaacaaaaaaagtttaaaaaaaaaaaaaacaacagctgagcataaagcataagaatgtagctgaaattgtgaacctaataaattacacaaaaatttttccagtaaaaattaaaggatatgatgaagatttgtagaattaccctgtattctttagcttttgttttactgattaaagaaataatgcattgtgcaggatatgtttatataaaagttaattatcaccaccaaaaatggtatgtgaggtaatgtatatggtaattagctcaatgtagccatcccacaatgtgtacatcatgttgtacaggataaatatagaccatttttatttgtcagtttaaatcaagaactgggggcagaaaagaaataaaagttaattattactgaaagccataatttaaaaatgaatattcccccaaatcagttagatttcatttaggattgttccttgagaggccacacactagtttaaatgatgctactctgctcaaaatttacttacttcaagttttattttttttggaaccgtaataagttcatgtggctcaaatttccagaagaataagggagtatgcagtgaagtcataccagcctcccaggccctcatttacctccccacaggcacctgctgtcttccaagaatgttttcatatcttccaaggtgttcgtatcttccaggggtgtttgctacgtgttccagtaaattggcatatatttgtttatttgtacattgatgtttcccctcttttttatcccaatggtagcattatctgaacacggtcctgcacatgctttcaagcttttcacaccatgagaatttctttttgagccaatttatctgcaacacaaaaaattattattttgaacttaaatagtactgcatagtttaattaccccctcatttttgccagattaactttgtttcatttttgtgttttggaaaatatggaaacagtaaaaaagcaggaatcaactgtcatcccataattggaaaacaatcactatgaacagttgtgtgtctccaggctcttcagcgttatatttttgtactttttaaacaaaaataggttactataatcttcatacaacgtgcctttcaaactagatatcaaaaatgctgtatgtttttccttattatttgtaatgtctgttatttcactgaatggctgtgctgtggttcatttaacttatcccccgtggttggaaggacgttgataatttttacttcttaaaataacaccaagaataacatccttgtagggaaattcttgcacacagttgtttccctaggataatacctagaaagggaaataacagattaaagagtttgcacgttgtaaaggtttttgatgcatattagttagcaaactgctcaccaggaaggtcatataaatacacgtctccacctggagtgtggacactgcccctttcaccacatccttgccaacactggctattgtcaccttctggaagtaatgaaaacaaaacatgaatgttttcagaggacaagtgtctacatcttgagagtatttgtttataagaataaagtgggccaggcgtggtggctcatgcctgtaatcccagcagtttgggaggccaagatgggcggatcacctgaggtcgagtttgaggccagcctggccaacatgatgaaaccccatctctgctaaaaatacaaaaattagctgggcatggtggcacacgcctgtaatcccagctacttgggaggctgaaacaggagaatcgctggaacccaggaggcagaggttgtggtgagccaagattgcgctgttgcacttcagtctgggcaacagagcaagactccatcttaccaaaaaaaaaaaaaaagaaaaaagaaaagaaaaaaagaataaagtgtatcctttgaaatcaattccagaaaagtggtcttaggtgatggcagtctgttcaattccacgtttacctcccagtgagggaggtgtctgccctgagttttgagaagtggcaaagtatgccccactatggtgacttattttaaaacaggcattgctcctttagctacataggttctggaatattgaggaatttgttcattaatttatagtcacactttatagtatacgcattataaaaatagctttaaattgcatgtacatctatagtgggtttttttgtttttgtttttgttttttgagacagaatctcgcttttttgcccaggctggagtgtagtggcgcgatcgcggctcactgcaagctccgcctcccgggttcatgccattctcctgcctcagcctcccgagtagctgggactacaggcgcccgccaccacgcctggctaattttttgtatttttagtagagatggggtttcaccgtgttagccaggatggtctcgatctcctgacctcgtgaactgcccgcctcggcctcccaaagtgctgggattacaggcgtgagccaccgcgcccggctgtagtggttttaactaaaggaattattgcatttcttcaggtcacttgttgagcatgtctcttatttatgacaagatgagttaaaatccattagaactagaagaacaggtgctttttgaaaatacattcctaatggcccagcgtcttcataggaaatctgttgtctgcagagccatcttcctagagcttccctcatcagtgctggaggaccaggtggccagtttcaagtagatttctctgaaacccaataaggagctgttttgtggactatctagtttttaatgctttgggaaacttttaaaaaatttcactatcttatctcagatggcaggtaaatagtaatttccagacaaatgcaatttgggctttacaattctattataaagccactttgaaatatattttaggacaagcccaagcaataagcatcttattttgggtccttttctaatttcccatcaacagcctaagttttctagcagaggcttattccacacttacataattagaaagtcttggagcccccgacttagagctgtcagagtttcagcccaagctataaagcaccagcctctgccacgcaccggctcttctagctttccagtgccagtgtgctcccgataggccggttcaccacttgccaatgagaattgtttggagcaaagcattttttatttgaatttcctagatgttttgaggaaaaaccgtagttggacattcagacagaatagaaagaacaccagacattgggtttgagcccctgattctgctactctgttgtgtgaccttggacaaatcatttgatcatcatttcctttagtccaaattgggggactaaaaataatgtctgccacatgggcctgtcacggcaataagtgaataaatgatctgtgtcagagtacttggttatctatgaagtattattcaaatttactcttcttattaccaagatttgaagccatttgtatgtagattatttttactggccgggcactgtggcttacccctataatcctagcactctgtgaggccaaagtgagcgaattgcttgagtccaggagtttcagactagcctaggcaacatggtaaaaccccgtctctacaaaaaatacaaaaatttgctgggtgtggtggcgcacaccagtagtcccagctactcaggaggctgaggagggaggattgcttgagcctacaaggtcgaggctgcagtaagttatgattgtgccactgcattccagcctgggcgacagaaaaaaaaaatttttttaccttcagatactacttcacataccccaagaagttccctaagttgggaaatgtataagttcatttatccttagtatttagctgtgtacatttagagggaagtatctatgtgtgtgcgtaggttttgcatattttatgtaaatgtcgtatgcatgctgtaatctaggtttggaagtcctaattttaacctctgtcaaaacacaagagtgtgtaatagatgaaatagaaggtagagcaagggagaaggaaaagccaaggatgagataaggaggcagtggtactatctgcagaactctgggcacaagatggtcagtgactctgctaaaggttgctcttcaaaaactcatccaggcagtcctgaccagtcttaaactctcaaagaatctgcctgactcgatgtgaatgaactgactgctattccaaaagactggggctataagtctcctgtatagttgtaaacttatattacaaatgtaaaatggctcttgagtgctaagtgtcgtagggatatgtatgactgtatatttcattgacatcccagtcaacaattgactgcatagatgacagtggtctcatgagattataatactgtatttttactgtaccttttctgggtttagatatgtttagatacaccaatacttaccattgtgttaccctggcctacagtattcagtaccggagcatgctgtacaggtttgtagcctaggagcaatagggtgtacgatacagcctaggtctgtagtaggctaaaccatctaggtttgtgttatgttcacacaaggactaaaatcacctaatgacgaatttcttagaatgtgtccccgtcatagcaacgtgtgactgcacctaacaagattcatatttgcaggcattcaaaagtgcggcagaagagtgaggtggacattgttgttagcgaagacttgaatggaacggtgaagttttcaagctctttaccctaccccaataatcttaacaggtaaggcacagcggcattacacgaatacatatctttcttgctttttttagaaatacaagtcttggctggccgtggtggctcacacctgtaatcctaacagtttgggaggctgaggcaggtggatcacctgaggtcaggagttcaagaccagcctggccaacatggtgaaaccccgtctctactaaaaatgcaaaaattagccaggagtggtagcacgcacctgtaatcccagctactcaggaggctaaggcaggagaatcacttgaacccgggaggcaaaggttgcagtgagctgagatcgtgccactgtactgcagcctgggagacagagtgagactccatctcaaaaaaaaaaaaaaagaaaaaagaaattcaagtctgaagtgacatctgataacttttaaacaggctatcaggatatcgtcctgtgactaagaaattaacatagtccttcttaatcttaaatctggaatgggttttcctcccttatctccctagaaatcatctcttttctaagttcacataacaatttatctatacctcttattacccttaatagcctctaccttgtatcacattcggttttgcatagggtttatctctgattcaacagcagtccttttaagggtagggaattataccttatttctctttccacccctcatgtggcccaattctgtgtcacagtcaacaaataaatctttgtcatttgaatggcattacaatccagtctcagagccagaatctaaacaattaataatattgtataattgtacagaattgggtaacagtgcaaaagaaagctacaaggcagtcacacataattgagtgacatggataatgattaccatatttagagggtggaagagatgattggatggattagtgctatatggaatgacgtgggataagctagaactttttggaagggtctagacagatgtacaggacatggatagatgaagagaaaggaggaaggaaattctaaggggaaagattgaggtgagcaaggcacgtttgggaggtggtgagtagctgtgttggcctcagggaagggtttgagtgctcacaggaggcaggctctgcagggccaggggaaggagtttggagtttgtcatgtgaaccgctatatctggcagcatgggatctagattctgtaggggtcacctaagctaggatgtgcctataaagtgtatttttaaaacctcatgggttattctttttccccttctttcttcctttctttttaagacagagtctccctcttgtcacccaggctagagtgcagtgtggcacagtcttggctcactgcaatctctgcctcccaagttcaagggattctcccgtctcagcctcccgagtagctgggattacaggtgtgcatcaccacgcctggctaatttttgtgtttttagtagagatggggtttcaccatgttggccaggctggtctcaaactcctgacctcaagtgatccacctgctttggcctccccaaagtgtgggattacaggcatgagccactgtgcccggctctcatgggtcattcttatgcagccatttggaggtcagcaatctctgatttgggggtattttagaattcaggagagaggtgtgaacacctgaataattgattggaaatgtttatactgtttctgataaacccattttcattttcaatcaccgtctactggctgccgtctgtgtgtatactgggagacgcacactgtagcccaacattggctggaagtgtctcctcacacactatgctcctctccacagtgtcctggctgagcgactggagaagtggctgcaactgatgctgatgtggcacccccgacagaggggcacggatcccacgtatgggcccaatggctgcttcaaggccctggatgacatcttaaacttaaaggtgagtgtggagccaagttagccctgaggcaaaagctggggtccccagtggaacatgcagttcttaggacagagcaggggatggggccagctgacctagtgaggaaatttaggctcctgcatcagtctttctgcataagtaaagaaaggacagttgtgctaattgacattggctatgaggtcatagccacagacaggattatgaaagatgcaaatatgcgaaacatggcacatgacctccctccctcaagctaggcccttgctttgtgtggttgggaaatgttgggagtagcagagagaggacctaggcaaatagatgggcatttccttgaagaaatcggttttccagtaacatctgggttgtgttgcagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaaggtgagccctggcttcgtacacaccatcctgtttaccttggctgtgcctcctgggaaactcaacacactttcagatttcaattctgctttgtcatgtagtctgttaatcacacagtgcggatacctggctggtttttaagttggagtatggtgtcctctgtgtggcctgataggaaacacaaatctccttgctggacttgttacttccaaaccctccaagaccggtctcttgcctttattgcaaaaaatgatgctataacactcgaatctctcaagttgcctgcttggccctcttccaagtgtactaaaaaaaaaaaaaaaaaggatgctgcactttcttgagtcaactgaaagtatttatgatggcctctgtgtacagaactgggttaggcacctgtgttaactatagctgtgtaagacatgacctctgctcaaaaagaccttctcagctgacttgtggagctaaagttatcatatgagaaataatcattgcatagggaagtatatagtgaatttctgaacttcccagggaagacagagagtaaaatagaatgtaatacgtttgtaaataaagagtgtgttcagacagtaagtgtggctggaaacgttaaacacttcatggatgcttcctacttgctggctgaagatgatgctcttgctgaacagtggggaaagctgtggaacttcttcattatcagttagaaaagagagggttggatccacaagattcattttgtccttgtccctttgcagttaaatgagggccacacattggacatggatcttgtttttctctttgacaacagtaaaatcacctatgagactcagatctccccacggccccaacctgaaagtgtcagctgtatccgtaagaatttgttatgttttgtttttctaaataatccgttataatatgtgggacaaggcagggaagggagactggactaaggaagggggagccacgtaaaggaaattaatatcgccagtcctcagggcagccttccttatttaggacatgcaaggagtagccaggcaagagagagtacaggaaaccattagttaatttcaacctcctaggacgggcgtggtggctcacacctgtaatcccagcactttgggaggctgaggcaggaggatcacttgagcccaggagttcaagaccagcctgggtaatatagtaagctcgcaagtctactaaaaatttagaaattagccagatgtggtggtgcatgcctgtagtccagctattcaggaggctgaggcagaaggatcacttgagcctgagagttcaaggctgcagtgagtcatgatcacccccactgcatgccagcctgggtgacaagagcgagaccttgtctcaaaaaaaaaaaaaaaattctgttgaaaatatatggccctatatacatatgtgtccaatggttcgtaaagtgttccttcaaatcaacagctacttattgaccactggtacatgctgttggtacaaatacatgtatgtgacagtaaccaggcataacaccctccaaagttacatgatcctatagtaggtacaaaacgtgaaagtgccagtagtgtcgaaggcaggatatggttaattgtaggagagttattgtggttattctttgacaattgcttgtgtctctgtctccagttcaagagcccaagaggaatctcgccttcttccagctgaggaaggtgtggggccaggtctggcacagcatccagaccctgaaggaagattgcaaccggctgcagcagggacagcgagccgccatgtagcgtgccaggctttttttttaaacttaatttatttaaaattccttggtggctttggccacagggaggtggttgaggcagggacccagaagcaaccgttatgagcaacaaaaggaagacactggtttggatggacgggaagcggttgggtgggctggactgacggaggcccctttagacctggcgaggtgagtgtggttggcacagggtgaggagtgtggaactgaagctgggctggccaagctgtggctggtttgggaacccagaggagctcactaccatgtggattagcaaaactcccctgaccgtgctgctggggacttacggactctttcctcattgtgactcgtttgccaacattattggccttttgtgtcttcctttgcctgatgtcaagtttagtgcagaacctcaggcattgctgagggctaggaaattgtccttgggttataagtggctgctataataatagtgatgatgataataattatagcagggacctcccttgacatttgagggggttttgttattgtacaggaaatggaatttggatcccagagatgctccaagactgttccttgtggtccctgcaggatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagtgagtgtgcactttgcaatgagtttaaagacaccatttttttttctttttctctttctaaggtttcttttgtcctattataattgagttgcttatttctgtttcagttttgtggtgtttttattttgttttgttttgtttttccttctcaattttttttcagcatcagataaactgctgctggcctggagggaaatggagcaggctgtggagctctgtgggcgggtaggagactcattttgggtttcggaacttaccaagggggtgagattttgtgctcccacttttcactttctcatcaaacactgggtcgatctctgtcaaaaatcaggtgttcctcaccatgctttgagcttaactggaccagctgaaaagaggccaagagagtagccagtgaagggagcccctctgtggccagatgcaagagctgcatgaatggacagagatggtccaggtttaaataagaagcaagggttaggttcccttggggaaaagccaagaccatttcctgttaggaagggcattggattgatgatcaacactccctcttgtcgaaggtttttgactaattttgttgggatgctaaatccataggaaataaaaggtctaggcagaaagtctcagggcagcgtaaatcagatgtcaccaaaaaaagttaattatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctgtgagtactggctggggggcccctctgtgcccagcacacacagacagccctggagcttcggtgtgtgtgtcaagggcaccctcagtggctgtgcgggaccattctctagagcatgcttccctgtggggtcacttccagcaaatcatcactgagcttcagtttccaaatctgttcagtgacaagaaaaacagtcttaagtcacgaagttgtaaggatgaattcagataatgcatttgagacgcaggccataatctgtaaaggctgtaaaatgcaagcagcctctacccctgtagcagactcccctgatttgttccacccaccctgactcaggcatagctcagagcagaaagtaaaacagagaaggaagaacctgatgaggcttaggagtttggacctggaaactattcgtttgagtctttgtcaggtatttggcattggctccatgaggggcggaggggtctaggcagatcactcctacctgaaggagatcacatgtgctcctggcgtacagatggagggaaccaggcaggccgcttgagggctgtgtcaccgtgagctcagcagtgttccctgattctctcactaggattcttaggacaggagctccaaatgtcagaactttgattctgtattttctctaattaaccctttattctcctctagttcttttatttgtatttgtattatttttttaagagacagggtcttgccctgttgccaatgctggagtgcagtggcacaatcatagctcactgcagcctcgacctcccaggcttatgcagtcctcccatctcagcctcccaagtaaccgggactacaggcgcatgccaccatgctcagctaatttaaaaaaaaaatgtttttggctgggcacagtggatcacatctgtaatcccagcaccttgggatgccaaggcaagaagattgcttgtgagcccagaagttcgagaccagcctgggcaacatggtgaaactctacctctaccaaaaaaatgtaaaaattagccatatttgacctcaagtctagacagaacttctttgtatattttagagaggagcaagcaagggagctgtacaggagactaagggaaaaacctcgaggtaagtggggttctgtgtctgccttgggcttctccttatctcatttatggggcatcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctttctccagcccaaatgccattagtttgccatgtttattctttgcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtgtgagtgagtgctgtggtcccgggcccttggcctagcagcctcctgtgcctttccacctctgtgcactgccgccatcccacacgggacaccacagagccaccagcagcccactcagctgctgctcgggcttcacgtcgctgttctttgacttggtgtaagcggggaggtcagaggaagggcctgtgctaattgttttcattcatctgtgtattactttcgtgtggctactgtaaagattagcacaaactgaggggctaaaacaacagaaatttgggctaggcatggtgactcatgcctgtaacgccagcaatttggggaggctgaggtgggaggattgcttgagcccaggagttcaagactgcagtgagctgtgatcatgccactgcactccaacctgggcagcagagctgtctctactaaaaacaaaaacaaacgtgttatctgagctctagagcccaggagttgaaagtcccgtgtcagcagggctgagctccctctgagggctcttggggagggactgtccttgcttcttccagctcctggtggttccaggcgttctttggtgtgtgactccagtctctgtctctgtcttcatgggacccctgtgtcccttatctgggtgactcttacaagaacacttgtcattggatttgagtcccacccaagtagtccagggtgatgtcatctcaggttctctaaagacgctttctccaagtacggtcacactcacaggctccaggagttgggatgtgggcatatccttcttagggccaccaattcagcccaccgtcatgcacggcagtgcaacttggttgaccatcgtctgcgtctgcactgccctcagtgcagtaagccacgctttctgtgcacaccgtcttaacgtagctgtgagtccatgggatgccacatggtggggaaatgggaaacaaaacagccaagaactgagacgggcaggcctggccgtgttgtgggagccagagctgttgggactgcaagccccattgtgaaaggctgcagagaaggtgacatggatgaaagagtgatttaggtgtcagtttcccttaagagcaaagggaaggagagagggagatggttgctcatggtggaagcaggagatggtgcattaggagattctcattgtcaaaggcagaggggacaatccacacacagtgcagagaacagaggggctggggtcgcatgccagagcactgagcatgccttgggagcgtgattgacacatcctcctgtaagaagagaggaacgggagaaaacaggatgacgaggtagagaggatctgaagaggagagggaggtgcaggtatgcgcaggtgatagcctgatgtgccatctacatccattgagcatttactgaatgctaactatatgcccagcaagacacacaggtgagaaggcatggcacctgttcccaggagggcctgatccttcaaggggcacagacagaggcatgagtgagagccgttcagggcaggaagggctaggaagcagctccaggaggcatgagctgcagtttctgtgcacagggggagctccagcttgtcttagaggagagggagcaacaagaaggttcacaaggagctgttccagctgaagagtgaggatgttccaggacagagacactgctttatcaaaggcagagagcctggggagtcagtgtgttctgagtggggacaggctggtgtgtgtggggaaggccacaatggaggatgaagctgctgaggtaggcaagggtgagcttacgtgggccacgcttcattttctttttttttcgagacaaagtctcgctctgtcccttaggctgaagtgcagctgctcaatctcagttcactgcaacctccacctcccgggttcaagtgattctcctgcctcagcctcccaagtagctgggactataggctcatgcccccacacctggctaatttttgtatttttagtggagatggggtttcaccatgttggccaggctggtctcgaactggcctcaagagatctaccccccttggcctcccaaagtgctgggattacaggcatgagccaccgcgcctggcctatgtccattttcaaagcacacaggacacatggcagtatctgtcttttcccttgatattaaaggaacttgagtgtagggatatgatcacatctgggatttggggaagtccctctccaggcagctggaggatctgagtccctggccaacctcagcactgagaagggccgctcagcaaggctggagttgagccgccgctgtgcagcacagaacagggtggggcaggagctggggcagggcctggctgggagggagccaggcagtgcaggagccatcccctgccatactttcggtccagggcagaagcacaggaggccaatgccgggcctctccccaggcatggtcagcagggaaggtgcagcaggaggaccaggaacgggaggcttgggtgcttaacatggcttcttgatgtgtgggccttgaggtttcgctggaggggaggatgtggagccaggatggttccacggcctgagggacacgtgaggggatgaaggactgcaggccgaagtgagtgtcaggtgtggggcctggggggctacatgggtgggttggggaccatgcagggcagagatcagcagaggggtgacctgaagattggccggcggtcgtgggctgtgagctgaggaggctcaggtagctggaatgggaacccctgcttgacccttcgggctgggaggggcagtggctgcagccccttgggagtcagggtgtccttgtttcttctcagccaggtcatagaggatgcaagccacaggaattcccatagcctttgtgtgtgtgtctgtcttctacctggaaaacagtaagaatactttcctgttcttttcttgtaaaagttcattaaggggctggatgcagtggatcatgaatcccagaactttgggaggctgaggcagatcacctgaggtcaggagttcgagaccagcctggccaatatggtgaaacaccgtctctactaaaaatacaaaaattagctgggtgtagtggcacacacctgtaatcccagctacttgggaagctgaggcaggagaatcgcttaaaccccggaggtggaggttgcagtgagccaagatcgcacatcgcacttcagcccaggcgacagagcaagactctcaatcataatcaatcagtaaagctgatgaaaataaaaaagcctgcaaattaatgtaggcacccaggtctccttaaatttagaatcctttcctcaaaagtctccgttgatacagaaacacttttgaagccagatgtgaagcaccagttgacccgcaggtgggggtgccaactggtaggctgtagggttagctctggcctctggcagccagccagttgtctcctaagaaaatactgtggcgtgaatgcaaaatgtgattcatcacttggctcctaatttcttttgattttgtcccctagagcaaggtccgtggtcctgtcagtggaagcccggatagcatgaatgcctctcgacttagccagcctgggcagctgatgtctcagccctccacggcctccaacagcttacctgagccagccaagaagaggtaggtcctccttagcagtgccaagtgtgaccatcaagggcacgtcaggagatcggggatggaggcgtttgtcactggtaaatgtctgtctgatggtattaccacctctctggatgtttgttgcatctgctgggtcctgtggggacaaaagtgatacatgtttggctctcatagtcccttgaaacttactaactagtttctttgtccaaggcttggatgactaactgcttaatgagaacattggaaatgctggtcaggcacatgctgttaccctttatccataggaagccacattcccttcagggaggccctgaagccctctgcccccactcaccctaccagtaccttgagttaccgagtcaccaccctcctcccggtgccactgaccttcccattcttcccgtcctctccctcctcttgcctgaaccatcgcagcagaggtgggggcagggctttctgcctcctgcctcctgcctttctgctgccaggccctgtgtggttgaattaatcttcacgaaataccactctgaccaaggtgttccttagtcagtcataaataacagcttctccctccattatagatgctcaggtctgagctttcgtcaagtctcatctgggccagcagtgcatcatcaaattctcaggtcctgctggagacctcacttgagagctcagggttggggcccagcagtctgtgtctagcagccctccgcccgttctccagcacactgcaggccacttctgctcccacgcccatctcttcctgtgttttgttttgtttgacaccttctgtgtgcagggctctatgggttcctgcaggctaatctctaggcatgggaaacaccgatgattacctggggcaggggaggaggttgggagtgactgataattcaaggtttcttctgaggatgacgaaaacattctgaaactagatatggtgatggttgcacagctctgtaaatacgcgaaaacccttgaattgtacactttaaatgggtgagctttatggtatataaattatatctcaatacagtctgctttgaagaatcttgttcttgtccttgggagtttgtagcctcttttggtgtttatgtgaccttggatacttaattttctcttggctgtatggcacgcgcttgtaatcctagcactttgggaggccaaggcaggaggttcgcaggagttcgaggcaagtctcctgggcaacatggtgagactgtctctctctctctctttttttttttttttttttttgagacagactcttgctctgttgcccaggctggagtgcagtggcgcgatcttggctcactgcaacctccacctctcaggttcaagtgattcttctgcctcagcctcccgagtagctgggactacaggtgcatgccaccacaaccggctgattttttgtagttttagtagagatggggtttcaccgtattagccaggatggtctcaatctcctgaccttgtgatccacctgcctcagcctcccaaagtgctgggattacaggcatgagccactgcacccagcctttttttttttttttttgaaatggagtttcgctcttgttgcctaggctggagtgctatggcacgatctcagctcacctcaaactcagcctcctgggttcaagcgattctcctgcctcagccttccgagtagctgggattacaggcatgagccaccaggcctggctaattttgtatttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaattttgtatttttattagagacagggtttctccagcctgttggtcaggctgatctcgaactcccgaccttgggtgatccgcccgccttggtctcccaaagtgctgggattacaggcgtgagccaccgcacccggccctttttttttttttttttttttaaataaaaattatttccccaacctctcatgagctcctggagtatagtagctagaccgggagcctgttccattcccttctggggcaggcactgagcctttaggctagctagaggccccatagatgaggcttggcagaaatgtgctctgagctcctgccatcagattgtcacattttgcagagtgagaggagttccagggcagtcttcctttatgtggcttattcccttcagtgatgtcctcaaaggtctagaaaggtggacctgggtatataggatgtctctcgtctccccacagcatagagctgaggttagaaaaagacggatgttttactacatgctgctctttttcactgtggcccagtcctcagaggaaacatgggtttcttattatagaaaagagagagatcagattagatgaaaccaaatcccagaacttgattttcaacagattccaaggaactgtgaatcctgataaattccttggccttttttttgtctacttcaaaaattggaaaacaggtgatttggagaatatctttagattttggcagtttgaaaattaaattcagctatctagtaagtcagaaagcagaaagaggtttttttgcttctgacttttattgagatctgtttgcttttttgcattttggacagtaacgctcatatgtggaaagtgcataacaagatgaatgaaagtattagtcagtgggttggtgttttaagacactcaggatcaaaataattgttacttcatttaaaaagtattatcaaaactctctagcatattttaaaatagcagtgttagctctgataactaataatgaccactttctaataatttgatcattttctttagtgaagaactggtggctgaagcacataacctctgcaccctgctagaaaatgccatacaggacactgtgagggaacaagaccagagtttcacggtaacagcttgtgtgagactcctgcgattccatgtcctttctttctatggcaaaatagaagagaaaatggaaatgcaatctggcattatcctcaacctcagtgtttgtttgtttgcttgtttatttgtgacagggtctctctctctcacccaggctggagtgcagtggcatgatcttggctcactgcaacctccgcttcccgggttcaagtgattctcatgcctcagcctcctgagtagctgggactacaggcgtgcgtcaccacattcagctgattttttcagtgtatatttataattttctagtacacattttttattattcataataatagtgatgtctaacaattattgaaggcttacaactacatgtatgcattatcttatttaatccttggaacacttaattccgatgatgaggaagaaggtagcattgttcccagaagcctgtccccacctgcaccattggtactactgctgagtatttgtgtgttgagtgctgggctgggagcaggaaccagccatggccttgtcctcagggccttggagcttagtggtaggtagtactagttatgagaaaactagccaagttacaggtacattaagacaaagcttccattgttgagagaatcctgcatcatttgcttagatctttacatggcctttacctgctaatcacttgctaacctcccctaactttaagcttttggaagaattacaagggataccactgtgaattgcagcctttgctgatgtagtcgcatgtcctcctccagtctgtggacattctatatctcttgctgctctcctcctcctggcatgataatgttttgatcagttcattgcttacttgcatgtctgtgggaggaagaggaagtctcatcaggccaagtcatgtggtgaggctggaaatccataactgagattagctacccacagtgagcatgggagtgagtgctgtgagccacagtggtactgacgtcgactttctaattcccacagtcacagaatctcaaggactctgagccaattcaaagaaaagatcctgtacagtttgaatatgtaacttagcttaagagtaccctgcagtcacaagatttattaataaaagggtttggctttttaatttgtatttgtttaatttatttgttttatgcagcctgggtcttgctatgttgcccaggctggtcttgaactcctggcctcaagcgatccgctcgcctctgcctcccaaagtgctggaactataggcatgagccaccatacccagccaataaaggggtttcaatatatttctttttattttttattttttgagatggagtcttgctcttttgcccagggtggagtgcaatggcacgatctcagctcactgcaacccctacctcccaggttcaagtgattctcctgcctcagcctcctgagtagctgggactataggagcttgccaccacgcctggctaattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 1769 - DNA, 61352 bp, Homo sapiens; identical to SEQ ID NO: 1768
  source 1..61352: mol_type = genomic DNA

SEQ ID NO: 1770 - DNA, 61352 bp, Homo sapiens; identical to SEQ ID NO: 1768
  source 1..61352: mol_type = genomic DNA

SEQ ID NO: 1771 - DNA, 61352 bp, Homo sapiens; identical to SEQ ID NO: 1768
  source 1..61352: mol_type = genomic DNA

SEQ ID NO: 1772 - DNA, 61352 bp, Homo sapiens; identical to SEQ ID NO: 1768
  source 1..61352: mol_type = genomic DNA

SEQ ID NO: 1773 - DNA, 61352 bp, Homo sapiens; identical to SEQ ID NO: 1768
  source 1..61352: mol_type = genomic DNA

SEQ ID NO: 1774 - DNA, 22803 bp, Homo sapiens
  source 1..22803: mol_type = genomic DNA
cctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcagtaagtacctcggctccctttctggtaggggtgggagtcctgagaaggcaggaagtggcccacttggtaactctgaggtgccatcagggcccccaggaaggaagctgggtgtgtgggcaagtgtgaggtaagctggccagggaggaggaagggacagaggaaggccacgtgggtccagcctgccccagggtgtcctgcttgcccaggctgtgggtctgccagccacttgcctgctttcagtttctaggtcatgctgagcttgttcccaactcggggctccgggcatttgctcttccttctgtgtttgtgctctcccggccctctttgtgggatctatgcgctttgggggactggggacacagggcccatgtgtatcttctgaaacacacgtcagcctgaactcttgctggtctgcttacttgccgtggttccctggccgcaatagcacataggtcccatgaggagggcagggactggctgctgtggcccagaagtacccaatcgctgtctgctcaatgaacggagaatgggctgctttcctggaacagcagattctaggatcacgtgccctcaagtgccaccctgcctacctcccgcaccgagtgaggcatcaggcgtggaagaagcccgggagccggagctgttccaggtgctgcctgagcacgccacctcccatctcccccccagcaggaagaggaaaaaacaaaccacgaggctcttcagagagaggaccccttgtcccctacccacagtgctggagctggcacttcctatttctgctttgaaagcctcaggttgtcactctcagaacagaggagagcaaaggggaaccctactgatttcaacaaaacaaagttgcccaacccgaagctggccacaggcggaggcagtgaaatgacaaaatcagcttggaaaagcctaaggaccctgggccctcgtttcaaaagctgtcatttgctacacgaaatgctgaggttcaggaaaaggaagacacttgctccaactcacacagcaagcttggatgctctcaatgaggtgtctaataagagctgaaggccaggagtcataagctatcattgtggcctgggttgctctgttgcagtgccttgtgacagcatggggtggggatggagaaagcaacctcagttaccttctcctccagtctgcttcttggactaagggtttaacggtcagagtcctggctgttaaggtttgtggctgatgcaggtatggctctttttatttttatttttttgagatggagtctcactcactccgtcacccaggatggagtgcaatggtgccatctcagctcactgcaacctccacctcctgggttcaagcgattttcctgcctcagcctcccaagtagctgggattacagatgggtgccactacacctaactaatttttgttattttttttttttttttgagatggagtctcactctgtcacccaggctggaatgcagtgttgcgatttctgctcactgcaagctccgcctcccgagttcacgcctttctcctgcctcagcctcctgagtagctggactacaggtgcccacaccaggcctggctaattttttatttagtagagacgggatttcaccatgttagccaggatggtctcaatctcctgacctcatgatccacccgcttcagcctcccaaagtgctgggattacagacgtgagccactgcgcccggcctttttgttttgttttgttttgagacagagtctcgctctgtcgccaggctggagtgcagtggcgcgatctcagctcactgcaacctctgactccctgattcaagcgattctactgcctcagcctactgagtagctgggactacaggcacgcaccaccacgcccagctaatttttgtatttttagtagagatggggtttcaccatgttggccaggatggtctcgatctcttgaccttgtgatctgcccaccttggccccccaaagtgctgggattacagatgtgagccactgcgcccagccaatttttgtattttaagtagagactgggtttcgccatgttggccaggctggtgtcaaactcctgacctcaggcgatccacctgcctcggcctcccaaagtgctgggaatacaggcgtgagccaccgtgcccggccaggtatggctcttctgaggggaccaggctggggctggggctgaggccaagcccaatctactgtgggctccacctggtacctctcctgggtctcaggcttatggggagtcagaggacaatggcccctccttactctgccactggcagagcccttctccctcggctgcctcctcattcccttttggctctccttttctaagttctgatcagaagtacaaaggtgtcaaggagtaggtttgacaaagtgtgacagcgcgttgttctatgtgaacaaagaaccactgagctcagccagcactgaggggcgcacgatgtggaagaactaactagttttgatagagctcctgctcaaggttacaaggtaagttaatggcaaagatggtcatacagtaatgagcagagagattcttgagtgcatccagggttaaaagtgaaaactgagaccacgtgtaatttgagatgaagcccttgttccaccagcccctgcacagtctcactgccccatgggacacaggggagggtgctctagtctcgggcgatggctgtcctaggaccacccctccctcccctcccatggaaatcctcatgctatactattcttttgtctttcctatgagtgcagaatggcggttctacaagctggacaattggggccaggtggggtgaggcagagctccttggtaggctttcgaaattgaggcaaagagacagtgttcaaagaaaagctaagtgtttgtatcgacggaacttgaagtgttagtgaagaggcagagatcaggcctcagatcctgcctttggaactcatttgttaaggcatgaacaggtctgaaaaaactacagaatgaatagcattccctgttttccccaagaagtccatctagacagtccctaaagagcctgcaactccaggattaagggctacattcagcggctaggcacagggttcagaaacgtcctgcagccgggcgtggtggctcatgcctgtcatcccagcactttgggaggccgaggcgggcggatcacttgaggtcaggagtttgagaccagcctggtcaacatggtgaaactccgtctctactaacaatacaaaaattagccgggtgtggtggtgcatgcctgtaatctcagctacttggggggctgaggcaggagaatcgcttgaacccaggaggccgaggttgcagtgagccaagatggcgccactgcaccccatcctgggcgaccagagcaaaactccgtctccaaaaaaaaaaaaaaaaaaaagtcttgcaagtgcatatgcacaccaggtagagccgggatgatcctggcgcactagcaggagcgggaggaggagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaaggcagaagaacaggagagcattgagaagttagcccctttcttgagagttcctctggggtctcacaccagggtgacacctgattgcccaaatcactccttgtgaacggctgggcattggggagtggttgatgggttagaaactgctggctctgggctccagccactctctcctaggcagccttcattcagggtgtacattacaaaattactcaaagcattggtgtattccgactacagcatcaattctggacaaccgagtaaaatccttgtggggcatggaactgcgtgcccaggaccatctcattcccgactgtagcgggaactccacaatgacctggagcatgggagatggtgcagatgctggagttcagctccagccctccccttgccaagctgggtgaccccggtcggcaagtccccttcgctctcggggtctcaggggctcaagagaggaggtgcggggtataaagggattggttaagaccctctcgattctgctcggttctcaagcacaacaaacagcgtgtattttaccgccgcgcggcgcagcgcgggacagtacgctcctccgcctgcgcggcgcccgcccggccggttacctgcgcttcgtcgtcgtcgccctccgcgctcgcagccccgaagtgtacgaccgtttccgggggctgagccccgccggcccatttaatcggcgggggcgggggcgggcgcctgggctgagcggacccgcctcaggcgaggcgtgcggggcggggcctcggccaccacccctcgtgcgggcggggcggggcgagggcaggtgcgcgcgcatcccaggccagcccctgcctctcgggcacctgcgctggaggccggcccgccggctgcctgccatacccgctgccgctgctctgcatccccaattccggcgggcacgggtgcagctccgcgtagtgctcccgaatccccatcgccggccaggccccgcccctactgtccggtttccccgcctgccccggcggcctcgcgcgctcgcggagggctccacttccgccggcagcgtggccacgcctcctctgggctgtccctcggctcctgggcggggccttctgccgcgccactcccccgggaaccctcgcctgttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacaggtgtggtccttttccccaaagacagggttccatccgtgggcgttccgccgcctccgaaacttcccccggacgttcaggctcccccctcttttttgggccccagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 1775 - DNA, 17700 bp, Homo sapiens
  source 1..17700: mol_type = genomic DNA
gattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacaggtgtggtccttttccccaaagacagggttccatccgtgggcgttccgccgcctccgaaacttcccccggacgttcaggctcccccctcttttttgggccccagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 1776 - DNA, 17700 bp, Homo sapiens; identical to SEQ ID NO: 1775
  source 1..17700: mol_type = genomic DNA

SEQ ID NO: 1777 - DNA, 17200 bp, Homo sapiens
  source 1..17200: mol_type = genomic DNA
agcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 1778 - DNA, 125369 bp, Homo sapiens
  source 1..125369: mol_type = genomic DNA
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacacttctgagcagccccgctgtcaccaggagaggagttctagctcccaaccatatttaaatttatgtagacctacatatacccacggaagtcagcctttataaagtcgtgtgtaaagagttttccttatatttgagccgggagctttctttttatactataaatatgatgagatcgagtctgaacttaatttctgcaagagaggaattatcccggctttgaaaagttagtccttttgctgaccgcaggtttgacgctcaagtcaccaaaccttctcaggaaaacccttagtaatattaaggcatcaggttacttgcggttatatttgaaatgtattttaaatatttgtcaagcatcgctgctgatgcctaaggaacctcgtgagggcttgtttttccttctaatttggaggcatctaatgaccgaaaaccgtagcgattccatagggtctgaccaggcacagctttcaaatgcagcttccctctctctagggactgcagcccacccagactgaatttcaatgcggtgcgctttgcttaggttacccactcacaatttcccactgcgccgcaggcagtatatttcagctttgagataccttgttttaaaattccagacaaaatggtgttgaggaaatgtctccttactagtcccatcaacttctgttaaaagaggaaaatttatggaatttgaaaatactgcgtatgatatttaaactttcatagacattcaaatgcttttaaggccaggttcaatttggttatgagtcgaggggtgggggggacccacatagaaatgtcctgggtcctcttgagtttatttctttgtttgaagatgtttgttcaatgagttttattgtactcatcttttatatggaattttaaaaagtaacaatttcagtattatttatattagaatgtgtcagaattatttccgtgacaaatcagatcatttgggctatggcttaaaatgtacacgaggcaaatattcatgacaagaagattcaccttcttacgctggcatcttgtaaaatgcagaacaagttaaagaaataatgtgtacacatacaaataatgatgtcacattaaaaatactacactattcttgcttgatggaatgtatctgatttccaatttcaccatgaacatatttcatacattttttacatgaaaaaaaacgtgactcttaagtctcacagtcaatcagagctggtgaccagaacattttattgaactaaatggtcatgttttcttccccttttgtttcacggtgagagttgaaggaaggagtttagaaactctccagtacttgtttaattcatcagtgttctaattagagtggtacctcttggaaaactacacacccccctaatgcagaaacatcatagcaataatcacccactctcagggtctccaggagaccacaagggctgcagataaaagtctggatgtgttaggtttgaccctttcgaagagttttacacaggctcctaaagagaagatcagctgtggccgtttgtagccatttcctttgtcgaaaaactaagatcgcagtgaatgtattagccaagaggtctaaagccctgttgtactgcaggccactgtcttccttgtttgactagagacttggagtttgagaacagtggttctttggtttggatacattttttgttcttgatttggatgtgtgtgtttcatgcgtggttaatatagcatattttcaatataaatgtcaaaaattttgaaataggaaagaactctctatatattaatgtacttatacacacacttcaagattatgcatttattaacagatacatgaaataaattccatgtgcatatgcacatatgcacacagagcgtgcacacacacagcatgcacacagcgtggagtgagaggcatggggcagtgtggaagagttttaacatcaaacagacctgaaatgagtattaaaggccccctttatttttaaacttttactaaaacaagatggatttccctatgttatataatggtgaattttaggcataaataacgttttttgagtgttgcataattgtacgtattaatgtaatgtaactgtggttaacgaagaattcatcaaggatatcactgttttgtggcattttttttttcctcctctaatctttggacttgtgaaataatttcactatgaaataaatgttggttcttgtcatattctaagggagattgatgtaagtggctccactccagcttacagaaggtaaaccacgacctttttgcgttctctgaaaacgcttgtcttccgatgcctctgtttctaagactgacaagcactctgggggcactgtgacgcctgcttctagcggcagagttgctgcagctcctgtcctggctgtgaacattgttctctctctggtgtctctatgttcataactacagagacttcagctctattccatttcatatttgtgctgaataatcattccattttatgggagaaaacacaagatgtaaaagcaacaagtgacccatcctttgaagcttacaagaagagaaacattaatctatttcacgtcttgaaaacagatcagttttattttgctcaaaaagggcacatgtacatttttgatctaggtcttagaaacgtagagtttcagaggatcagcattatacacactgtcacacacacacacacttaaaattcagatgaggaacaagataggaatgaggttttgttagggacgcagagcacctaaaaccaaaggatatcgacagtaacaaagctgtttttactgtagtgctgactgaacactcatgctggtgtcttcatgtggaccatggctttcttgtatttctttgcagtttaataaatgacttcatatctcaggttacctttccacatctcctggaatatatgtttatgtccttaaagtttcagtgtcgtcactttagtagctttagtttgagtttttaaatgtttggtaatattccaacaaatattttttaagacattatgaaaccttatgaagtgccatatattacaagtgagataaaacagcaagcaaaagaaggtttgcagaaggtttttaagtggcgaagtgcgggcctgcccattttggtgtctccttggtggttactcctgagaagggcctggaggaagagcaactgaggcctaatctacaggcaactgccaaattgtttcagttgacgtttttccctctcatgtttgactataataaataggtagttgccagtggagccttcagccaaccacctggtaataaactgttaaaaatggtgcaaaccctaggtcacaggtgtgggggccatttgtcttgcctgttaacaggcctggccttaattcttttctcccatggccatttctgcctttggggaactcacaattcctgttgactaaaagagcacccttttccaccacaagcctgacaaatcagacgtccacataatttctgaactcgttttggttaggacaggaagcacaggctcccttcctgtctgtgttttcctaagagaaaacggtcttccctccttttttgcatatttggcaagtggttccacctttctctgcaccctggtggagtgtgaaggcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttggtgagtgccacacggtttctttgtgtgcttgcatggattggaatagccattgtgttcttccgtcttccctgctggtgtttccacagtgggtggcctgagcccagagcagctccccatatccctgtgcaggccacctgtctcgggtgatggagagcatcattatgctccgtctgaacgctctgctttcggatggccccatgctccacctcctgatagctcgtggcgcggggccacggcttaacgaatggctgaaaatgggtcctaattagtggaaaagtgctttcttcatattttctcactcgagtgtgcagtgattcatttttcttctgcaatcagctcactgctaaagtaaatctgactctcttcccgccattgcacaccaaaagttaactctaatgggtaggaggttaggtttgttgagagagcaatgcagtaaaaagaggggatccaatgtggtcttgtctgtctggtcttcctttcttcgttttttcctcccttgtcttctctgtcattcccttccctccatttgccttgcctttcctgtccttcccttcccttccttcccctctttctttctataattggtggggggtttgcacagactgccaaaacactaagaactgtgtaaagtgtttttgaatggccttacacatattgaagtagatttttatgctccatttttgagatcacacactaaaatctatacctttaaagcattttctgttagtttgaaactatttgaaaatgaacaatgtggtttagattagagtcctgttctgaagctaggagttccactatgaatattgatttatcagtttttgacaaatttttgttgttataccagattttcactggcaaacctagagcaaataaaattccacataagatacttccctagacctaatgggaaaaatgtttaatttagagtctttaggagaaatgagaatgaggaattgaccttttgtaagcttacttctgaggcactctgaagtgtgttccagtgcttttaatggaaactagagagagccagcaaccccctagtgtgagccccacttttaaccggaaaaagtgaccttttcctcctcctttgtgctgagttttgcgtagggcagaaaattaagctgatattcaaagagattcactgcaaaaacatattgataaatcgtatattctatttcattaaattaaaaccatactgctaattatctcaggttgttaaacataaggcaattaattatcattttaaaagttggtaggaagttgtgagtacttttgcagtatgagtgttttcccgctttagtatgaggttgtgtatgtttgcttgaatttacagaattttcactttaagagcagacaatgttttgttaaagaaatgaaatttgctaaaaaggagcatgtaaagtgaaacattaaaaataaataatttcaacttacttaagagctgcagaaaaatctgattgctgtgtttaaaatgaattttcccacatttcgctctcttatggacaggagcattttctgtcaggttataaataaagacatgcccattttttgtacccccacaaatgaggaagttgtaagctctctgaggttttactgatgagccccctccccctgggtttgcatgaagagatcataggccacaaataaaggactacaaaatggggtctaaactatcctggtggggcctgatacccacgtttcgcatggaccttacgatgtgatgaatggttttggcatgagtgtcttaagaatgcttccagattcaggttacaggacagccagcgctgagctccctattgcagaacaaagtaggaatctagaactttcttgctaacaggatccagctaaaacaccaagttagattcttaaatgatgttcttttctgtcattatttgattgttgtcagtagcagtaattgttaccaagccattgatgcttctattcttccctttgcccttctgagacacagctcattttgacttcagtggaacccctcgaaggtggggtgatgagcaaggtgaattttcaaagtaaagctactaagagaccaaactacaatttaaggaacctgatttttgaatcaaattccatatactgtgggtatagttcaacatagattaatttcttatagttattatgaaaaaaatctcatcttgatgatagctgataattttgtgggtgtcgtaaacaaaacagaggtcagaattcagtcccttggggaaaatttccaattagtaggaaaccaagtggcctaccttagtttgaagacacccatcaggatgtctgcaccttttcatcctctctggaggaaagactaaatacccattattgtatataggtcaggccaaagcagccttttatattgcaaggaataagaggtaaatagatatatgtgcaacaatgaatcccctaatgtgtttactctagaacacatgttctttctgtatttatatgtagattttgtagatcttgtcttaccacctgctaatggtagatactgtatctaaataagttgaggaaaatttatagtacctaggaatgtgtcctcagtgggccaatcaatcaatcatgacttcaggttatttttaataaatatacacgtatgggttcataaacaatgggatgttcttgtgaagatctaaataattttacttctttgggactaaataaaatatagcttttgccaaataaactcacacaagcacttattttaatagaagtcaaatggctttgcagaaacttcagttttacaggtgcattgtttgaaatgttacgggtatacaagtggatttctctattatgtacagtgttaagtttgagtttcaaaatgtccacctgaaatgatttacttgtacgttaagataatttaactgctaagaaggcaagataaagcattctttgtgacaccatatggccttgctgagggaaaaacttactgttataagtttgtgtttatctctctttttaaaaaaaaatgaagaaaaaaacgtttaaaataatgggaacacagcagttcctggggtcctctgtctctttatcttattatagtaaattaccaaaaaaataatgacctggggcatgtctgtgtggacccttcttttggaggcagtttctgtgttttgtaaagctgtaggttctattttcattgcacttcatattgctgcacagctcctgaccatgcatgaaggtcctctgaaatcggtaagagggcagaagaaaatgattctaaacttagatttttttaacttaagtgatgaagtgtgaaacgccatttatatttgaggaagctacctaggaagtggctcatgtcgatggcccaaatcagaagagggcctgtaaaagcttctatcaattttgactgtgtatgcttctaccatggcggctcaataaacagcagtattagtttaagagtggatggtacagtagtatagacgggaagcctctcctctccgtgtgaaccgtgcacccctatgagagggtagagacaatacaatatgcctgtaacgtcaggacagacagtcatggccagcttgaactccagccctgggcttcttgcagcaacaaacgtgaacacagaggactgtctccaactccactttctctatttttaaaacaactttttgaatacagtatctgccatcttttcttatacctcactttgaaacaggtggctccactgtggcatttaaaatgttctgtttcttttccctctgtatcaaatacctctttaccaagaaaacattcaaacagcatagtttttaactgtattttgaaaggtttccttagttccctttgacccttcctcttttgcatatcagttcctggccataaaaataaaaaatgctaggacagaattgcacatctgagctgatttgccctcaaaaagtttcacagtggaacaaaccgcaggaggagttttctgtggctcagttaaatgtcgggggagggtggtgtgaaagccaaattggattcctgctttcctgtttaaatcttgtttttcattgttatttgcaccagcaatactctgtggaataatcatgaaaatgtgtagattggcagctaatttttgaaaaatgaaaagaatcagaaatgaaataagagtgctcggaagtttttatgttctctcaacctgttttgtcaaattgttacgaaaacctataaggtctctttgactagatacaaagactttgcatattgccttagctttctcttgaagcatttccttttttaaaatacagtgtaattcacagtgatatgatagatttgcaaaagtaaaatctaccagtctgaagatgaaaggacttgtctcttagcaggaataatgggttttattaaagaggtctgtgacctaaggcattttaaataaattacaggcttggtccctgtctctcccatgtatctactcccttcaatataagcatcattgagtatttaaggaaataaccccaaatgtaactctagtgtagcttcacttgtcagggaggaaaaagtaaatagcatacatttggccaaataaccagaactttactgtagaagttttatgatgaaatttgcctttagtgcagagtattacaaagatcatgtttagtttctagcagtatataagtagcatccatccttatctgtcatgcatttggagtgcgcgacccctgcactgggctgcaacattctgatgggcaagagtgctagagagaaagaggcatcaccatcagactgcacgggttcaagtgtcagctctgtggttgattagctgtgtgacctggggaaagctatttctcttagccttggttctctcatctataaaatggagataatgatgcagatgccttgggtttaattgggagagttaaagacacatttacatatttagcaagtaggtgttgaattctagctctacattggacactatgccaggtgctcaaataaacaagtggacaagacagacaacacccatggtcttatgaggcttaaccatttgcctcttcaatgccagaaacttagtaggttgattagataaagccagtgagtaccagtatccttttctttgcagccttttcctggcacactaaaaatactcagtacatatgaaatatcactggacaaagaatcccccttagagtaccaatggagaaggaaggcatttgcttaaaagcaaaccaacagaaagacattgtaaggcagttgtttaagtctcagagacctataatttttttcttttttcttttttttcatctcgctctgtcgcccaggctggagtgcagtggcacaatctcagctcactgcaagctccaccttccgggttcatgccattcttctgcctcagcctcccaagtagcagagactacaggtgcccgccaccacacctggctaattttttgtatttttagtggagacggggtttcgccgtgttagccaggatggtcttgatctcctgacctcatgatccgcctgcctcggcctcccaaagtgctgggattactggcatgagccaccacgcccggcaactacaattgttcttaaagcttgtagaattactgtgtgctaccaacagacaggctaattttgagtgaccctcagtactttgtacagttaatttggcacgctgtgtacttagtggctttttaacagctataaatttgggctgctagaaaagtagtaaagttgtgattcttgacaggcatctatctgcattttcatttttacttcatttgtctagactcagcttgtcagaattatggaagagactccttgtgtcagggcaagcactgtgaagagaggtattcactgtcagaaaagagaggggagctggaggcagctcagaggcctgagacccgcctccacaggagccccagcaggttcggtggagctctggccacactctcctttgggatgctgaagtcagaatgagttcacttcccagccagtcttgccaaggctcctcacctggaagcagcaactgcccagggctgttggatgtttctccccaggggacagccaggtcccagtcccacctcggtgtggaaggaggaaaggcagggtccaggaagctgtttcaggacaggcccaaggtcccccagggatgcctttcagggtcagcggaggctgtaaatcagcagggcccacacggcctggaagaggcccctgtgctgtcggcttgcccggcttgcccggctcctagtccggcttctgctcctcctttgtaaagttatggatatgctaatagtttccaactgagactaggaaagtaagtcctacttgacactgtttggtcagaaagagggagagaaaggagaaggacagagagagactgagagagagacagtctcagacaaagggagacggagggagggagggagagacagagaaagagatgggaggtaggtgtgggaggagggagagatgcagaaggcagaggaaagacagacagagatttagacctcccaagtcagtgagcagtccagagttggagtggagggtgcctggtggcttgtgactgcagactccactccccgctcctagaggcacagccatggacagcttctgtcacgttggccctgcacttatctctgcatctatttccccttgtgcaagattcagaactgcatgctccaaaaaaacaataaaagcattcatgttcataagaattgcacaggtaaaaggtagtttgctgatattgttgtattttttactatcgcttcttttagctcttgcctgaaattgtttgggtttcccaggcaaagtagaaaactgcggtacgtttctgtgaaataattattccttctggcatctccctttacagacctactgatcttgatttttcatttaggtgaaagtttgtgaaaacatgccattagcttgctttgtgattaactccttttactgaatgtgagctccttttaaattgaggccatatcaagcttaaattccatattttacccggcactctgcatttcttccatgtgggagaggaggggctcagtaagtgctttgtaaaatacacagccgaagtgatgcacgtgctaacaaaggagtgtgacaggacttaagtgcccttctagacacttcaggctcccctttgtaagctgtcttggaagaggccacatttcctttccctcaaacagtttctcattgtttgattattcttttagcctttctctggaagcaaagccacttttacgagaaagtcactgctttttcatctcaagagatgcaagtttggagtttggggaagttttcaggtgcccgtcaagtcatcctttatgatgtcagacgagtcaggccacagaattcacagggctcagtgcagaccgaaaacttgaggcctcttgttcagaaattattaaaaattttggtgaacatcaccccaagcaaagagatcccctaagcaccagcccccaagcaactgcactcataagcccatgaagccccctgctgtcagaaacaatgtggttgaaattgtgtatgcacttggaagtgagatggattgcaaaacacaggtctccatgctggggcaggagtggtgatagggcatggagtggaaatgtccagcaggcccacgtgcgaaaatgcagagctctctggctcttgcagacttggctgctgacaatagacgcgctccaggaaggtgctcgctgtggtgtgatctgctgcccacccctagctccctccaggagactggtgcggggactgtttgcaaatgactgcaaaagtaagaaggttcccacagagcagagcttgatttggggaccagccgagggcagtttgtcaggattccggcttgaaactgttctcacatctcaccgcctgaaaggacgagtgtgtccagaggacttagcattgatcacctctgtctccatgcagcaaactcagaggctcagcccgcattccactggaagggcgtttgccagtggtgttggttggaagagccttgactttgccttaggaaacatctttttttaagaattgaaaataacttgagtatgcaacagtagggcatttgttatataaattagttgactagtgtgtagccagtaaaatgatgatggtggtgtgtatttgttaaataaaaagatatgtgtggtattaaattaaaaaatattttaaaacaacatatttgtaatctgtttagtgtcctctttttgtaaaaagtacagaaataaatatacagaaaaaatagtagtcctaagtggtagaaattatgagcattttcttgcctttaaaaaaagttgtaaaagattgtatcatttatgtagcaaaaagttttaagtcagcattctaaaaatttcgtgttgttatagttgctgtgacaagatttaacttctgtatgcttcaccaatcaatacagaggtatttaagacccggtgtgtgataggccgcgctaaaatactatacacatcttcagaaaactagagaactaacttctaacttcctatattagtgtggcacggctgttacaaagatttttctcatttgagtctatcttgcttctttatcattgttttgacagtttcagaagaatcgtggcttttccccttttttacagtaaaggtacctgagactcttgacgtattgctttttggaaatgcttgtgctggtcacatgcttgcatctgggctagtgtgtctggcttccgtgtgctggtggatgcttactctgttttctgaaatactttttctgtacagtggccactagctgtactcctaagccacacacctaccttgaaaattcatgtcacttttagaaatagataaaagcccctcccatccagaaaaagtgactatcatgtatatcctcatcatgactaatactgatattcctgaaattgaaaatacatattccatatgtaccataaaaggtattaaagatatatggagtgatagatatattatatataacacttctaccctcacagttttcagcctaattgagagggtaagatccctgaatcatccatcagtttttcaggtctctgctgaaagcaggccacagctcagatccacacatctgaaccagagacagaggtggccaaaaataaaaagggggacagggggacaacctggtttagagtcaacaaatagactgcattttctggttagtgaaggagctctcctgaaagtcatataccagagcataaatgagcagatttccttgaggtcaccttctgctggccatagctttcttatctgtggagctgccagctgtcatccactttggggcacctgagactgccgagcggcaggccaggacccaagtgcgaaacacagaacacctttttgtttctactccactgatgctggggttctctccctggtgtttgtggctcgtagtacactctgtggaacattcactatggtcatcgaagggcagcatcttcccagttgtttctttcttttcttttttttttttaatttaaaccgatctgagaagccagccatctgtcagcaaaacaggaaggctcgggctctctcctgggctcgttttgctgccgtagtgagcgtcacttctccccgtgtaagagtgctggtgaaggctgaggcaagggcccagaaagattgagggacaaagacaggagcgcccgcattgcccatctgccaggctggaggtgtattcattattgatggaggtagtgcagttgctgctcagatatgcagccctgcctgggtaaatgagacattcttcagcaaattgcttcgttttttgattgctgattgtacgcgtgtcaccaagctgactcaaggttcatcgatgcatgctcagtaaattagaaagaacataactatggatcagccaagagaatgaattctgtgcctacaatgacccagggccatttaattttctgcttaattttgttgcagtcagtttgcattttgggttattatgcagtaggaaattaacaataaataacaaatttggtcctcctgtgcttgtaatgatatttttataaatctttgtaatgctgtttttaaaaggatcaaggtctgtgccagtctgatactccagcaagtatgtgaggaggaaaatgcattattcttgctagataaccttgttgttaaatagcataggggttctttatctctctctctttctcatatcttattagtatttttgctttaaactaaaatcccttcctctctttctcagataacctgaggaccatggatgctgatgagggtcaagacatgtcccaagtttcaggtgagaccttatgagatagctgtgtgggaagttcatgagaaaagcttccctggggccggaagtcacagtgcttggtatgctcatgggggaggaataggggctattctgcaaaagaaaagaccatgatggaatttgcctgagtgtttccttcacctgttacaaattatctcactttgagctgaacagaaagcctccaagatgaaattagttttactgttaaacttcaggaaaaaaaaacgggaagagttaaatacatttttgtactgttggaaggaaaaatggctgattggtttaaaacccaaacacatgccaatgatggtacttaaagagagagagagagagaagcttgaaaaacataattgttgggcacagtcatgactgtttgttcattaagcatggacacaacattgctcccctttgccatatatcttttcaagccgtattggatatagctcttctcatccaggagacccaggaagtggagaagtctgtagtaggaaaagcctaagggtaggtcacagactgtgaccatttggcagcactgagggtggacggcgagccagtccaacaaaaccgcacagttccccagtgcatggacataggaagacagctttctatctggccctgtatccagaggcgtcagccccagtagcagctttcatggactttggggttttcggtatttcatatttttgagcctcacagactcacagccagccccagaggctgacttatatttgagaaagttctcagtggcaccttgccttggctgagcgccctcgtgttttgaagtttctatgggattctacaagttggtgctcctgatgaagaccaggacctatgtgtggctgctcccctgcttggtggtttccctggggaaggtgcaggagaggatcttctgagttccatggaactggagatagatctgccaatcacaggcttccttctccaccactcctcagccgctctattcatgtttcagattttggacttaaactctcccaggtgcaaagaacaaacaaaaggctagcttatttttcttttagagtgaggcttcgtatttattacaatataattgccacattctttgtgtaattctcacatttatatcttaaatataattctcatgaatgagaattatataattctctttttgtatatcattgaatattttcacttaatttttaatttttttaatcgtcacaaaataattgtgtacatagacacaaaataattgggtacatagtgatgttgtgatatatacaatgtatagtaatcggatcaggtaaatcagcatattcatcatctcaaacatttatcgtttctttgtattaggaacattcgacatcttccttctagctatttgaaactatatattattgttgactacagtcatcctgcaatggtgtagaacactagaacttattcttcctacctagctgtaattttgtctcctttaacaaatctctccctatcttccactcccccgacctttccagcctctattagcctctgtcctactttctacttataatgatgacagcagcatttgttagtttccacatgtgagtgagaacatgtggctttttaacttttagaatgtggtattcaggcacttcatggtacagttggtaaaagtgaaaatgtgtccaaaagtttgtgattatctatataaacaaaaatggtataaatccaaatatcaattttgcattgaagaacttaccttagaggtatattctcacaagtgcacagagcatttaagcatttgttcactgcagcattgttatcagtattttaaaactatggtacatccatgtacttccacatacagctcttaaaaataaggaggatatgaatgaactagtatgaaaagaagtccaaatacatgtgaaagtgagaatagcatggttctggatggtatgcaaagtatgatctcgttcttttaaaagaaaataaattacatacacatacatattttctatatgcttgcccataacgtttaggaaaattcttgggtgatatttattaacctggacttcctcttggaagactgatggtagaaggaaggggacgagttagggaagaggaggagaaggaaaactttgcttttcatcttctaccttttagcattatttgaatttattttccttaagcgtttactttgtttcgtaaacaaaaaagcacaaaaacaaaaaacgagttaaatgggaaaaaaagcagtttagctctttatagcctctcatttggcttcgccagcctctcactgcagcctcagagagctggtctgggaaacactggtagatgaggactgtaatcctcactcatggaagaggatctcattcactgggtttgctgactgtgactagaagtgattagggtgtcaaaaaacccaagcatgttaaaaatttccagaggccaaaaagatgctttcattgttctgctcttcttttccttgtcgctttcactttgggtagcttctaaattggtattttgcatggtgcatttaaagaaaatgagacccctttggccaatgcaggagtctacactctgatattctagagtcaaagctgaatgctgacacctaggaattcatctctagaatgtttatataaggaatagcccctcagtattccgatctcgtatcttagtaacgaaactaacaaaagcctgattctcctctggtagttttcttgtctttaccataatacaaaataagtaatttgttctgcaccctgactgttcaaaggatagggtagctgggggcggggacaagaatggagaccttattacataagacttcctgaaaaaggaaactctgtttttgtttgaaatgatttggtctgaaatttagtttgtgtacacttaccaaagggattcctatttctaaaatactcatactgcttttgattcctgttaacctttgagcactctacgtaatgatgagagcacttaaagagtcatgtcacttttagtaaagaatcaaagaatactttttctacttcttcgagtttgatctctgcttctccagttaaaaccagtatttgtttttttcatttctaaagttggaagaaatgacagttagttatggcataaggatgtacatttaaccaaataggagttgacattcttggtaagaaatcttaccaagattatgttatagattataagaaatcttatcaagaatatgttcctaaatcatcctcttttcccataaaatattaaagtatcagcaatttcataggattcaacctaatgtatgcgaaatgctagataaacagataaatacttaatatctggctttttttcaaagcactgggttatttgttccttgagatttatcctaaatgtgggctataccctggtttacagtgtctcacagatgtgtagtagtagacactccataagtgtttactgacttgaatccacagggtactgagaaaatgctactgatagacttggaggagagcatatctaaagcaagctaccctttcctttagggcacgtctcactaattctttgggtaaagcgtatttttcttccttttgtgtttttggcagtctttccaaaaatacgtgttatacctatgcattattttttggtttggtttctaaagaaagagtcagccggtgggaaagtgaaggatgtgggaactgagagatctgcatcagcatcccacctctacctcccacgatgggacctgagacagttatttttgcctcctggaccactatagtatcatctgtaacaggagggacttgagccagttgatctctaaggttcctctggcacctgtgaccctaaatagatattggatattggtttaatgctatttgtagtgtgtttttttggggatatggaaaccagaagtttgtttccataaacataaacataaactgtatatatctaaaggatatggaaacctttagatatatataatctgcttacgtaaagaaggtttgtatatattgcagtgtcaatgggaatattttatcaagttaagcatagtaaatcacattgattaaatgctttgtatttaccaaacattacccaaagtgttttctcctttcaacctcacaaggacccacagaagaaaatacagttatcatttccaacctgcagggagctgagacacagagaatttaagcaactgaccggaagtccaacagggagtcagagattgctctggggtgtgatccccacttggaccctagagtggaagcttctccactactttatagagttgagattctatattttgagcttgtatttacccagagaattatatcctcttgggcaattgtgtataataaaacctcatgcatttaggagaggcgggatgacagaactttgttgagtgaattataatctacttgagaaattatttgcttacattttataagctaattataccatatctcatccagttttcccagaacacttctcataggtaatgctttatttgaaacataggccataggtaagttaagtgtaaatgtgtatttttataatttaaccagaagtttatttcatttttctaaataagtgaaattgtattgcatcttctaaattattctatttaaacacttgatgtcttgctgtctccgtctctgtgtgtttgcatgtcattgtacatgttcttaggaaaagtgtgggagcttgacgcaatatataccttatgtttctatgtgcatatagtttaccaaataataccataagtttacttagcatattagaatccatgcacattatttttattttatcttcaccgcaaccctgtgggatagaccaaaatcatgcttttcagcctcctttttccacttgaggaaaggagtcttaaaaaagggaccagtctcatgttcccattcgtcttacaactaattggtcaagccagaaagccagaactatgtcctgggtcactaactcctagtcactgtgtgttagtatttgagatgcctgttggcttgatttagtcatttattttttagtgttttataatccttgcatacttttacattttaaatggttaaccaggcaaattggtttaaaatcagtgcataaaaatactgtgcctatcatgatgggtttcatgaagtgataacttttcatcatggagatcctcagctgtcacagaagatgaggggccctgggtacagaggctcacgtgagggatgaaagtctcagcagcccggacttacactttggggcttttaggcaaatcagacaacctcttaagaactatcactgagttcaggcaaggcgagcttgaattaacacagggcccttggtgggcatgtgaatatatctcacttcactaccatccagttctgactctttacgagatgcccctgtacataccaagactgattttttattctcccttctccccatgtggtttcttctgcatagagagttcctattgatcagtctgacccatggtattttagaattgcgatccctactgtttcattattcctttttctcccccatgttgaaaaaaataaatgtcctgagatgcaagatcagggacactggagcactgacatttagttcagtgcaggaactgaaggcagatgtaattcttaagaagcgtacctgttattatgaaccatcctcaacaaattgtagtggatcttgttttctcatagatacagcagttaaattttttaataaaagtaactaagagttatttggatgtattttagcatgcactgagcggaaagtacgacatttcttcattgggtaagtcctgattctttatgatcctcacttggttccagggccccatgcatctaagggtgtctcagagcatcctgcagtgctccagcatgatcgcagggaaaagctataggaggaaaagagtcaataaagtttagtttctcaacctcccacctccaccccataataatgacagctggttaatcatgagacacgtgcacaccccacacgccctgtacatgtttactcattgggatagcatgtcaggccagaaggctccatggtcatttctatgaaggtactttagcaggtcttcaagaaggcaagtggcctgggtccctgcctccccaaattgcaagctccctgctttatgtaggagacctatgtgtatattacagttctgtgtaagattattttgttattcttacccccacacccaccccccaaccccccgctgccaccaaaaaaaaaaaaaaaaattcctctgacaaccttcataaagtcctgggagtttgaacaccattgctctaggaagtcatcttatacaaaaataagagttgtgaggtggttcatatacctcctgcgttctcctatttggagtttttccccatttatgaaagaggtgaaaacgctaagatatttagcaattgttactttaaacattttctatttataggccgggcgcagtggctcatgcctgtaatcccagcgcttgggaggccaaggcaggcagatcacgaggtcaggagatcgagaccatcttggctaacacggtgaaaccctgtctctactaaaaaaatacaaaaatttagttgggcatggtgggggatacctgtggtcccagctactcgggaggctgagacaggagaatggcttgaacctgggaggccgagcttgcagtgagccaagatcgcgccactgcactccagcctgggtgacagagcaagactctgtctcgaaaaaaaaaaaaaattctatttacagcagtgaaaatagtagcgacttaatgcacattgccaaggctttagcataacatgaacactttcactcaatgtctctctggccttttgtttttccttgggaaattcttataatcctgctccgtctttaactattcattttgtattggctatccaaatatacccaataatgctctttctgaaaatatgccaattgtggtaattacagctaagctggaatattaaattgtgatgtctgttttccagagaatgaagtagtattccccagagcataggcttggtgcctgtgcaggttctattttaaatattccaggaagggttgttttatatactgaggatgattttactggtcttgccagtcgtctgaaatgctggtattactcttgtggaaggtttattcaaacaaacaaggacatttcacacaatacctagtcatgtttttcagacattttaatgtttggttcatcatttgcacacactctcaaaaatctaggtttgtctatgtgttcatatcattttgcctgttgccagctcagtcagcaggcacactctcccaggctgttgctgttttgttagacttcttcaggaccttcatctaaaatggtcttccacacgtagctatactgcataagttcacatcatctgtttcttgcatgtgggttgtgtctcaactcaagtttaagttagatttggaagggcggaaactataggagttgcagcttcagtggagaaaagagcatttcctactagttatggcttcccaaggaaggttagattcctcagagtaggagtgattccccaatgctagaacctttggtcaaatataattctaatccagtcaaaataaatacaggtattctgtaaaacccgatttcattttgtaaatcctactttgtatagtataagcaatttttgtatttgtgtggattatattttattttcctatttcaaagagaagaatttgtattagcagactccctttgcatgcggagaggggatcattttcccagtaggcatggggttcccttccattccttgtccagtcttcttttccccactaagttaagtcaaactaagcagctggtaagatattccctggttcttgcaaagaaagtgagcagatggcagaatgtatagctctaagcagaatacctggtgtggtatcctcaaacacaaattgacaggagggtgtggtgtggcaagctcattgtgggggtaaattggaataagcttacagggggaagagttgacaaaagataggaagaaccttaaaaatatagatgccttttatgcagtgataaaatgtctagatatttatactgtggtgattattaggaatatgtgcaaagattggctattaggatgttcattacagtgttgtttaataattataaaaggacagaaagcaatgtggactcaaaaataggaaaagaatttaaataaatcctagtgtacccgttatacatgaaattatggaaatatgaccctgagcatggaaatatgtacatgagaatgtctaaaagctagttcattttgaaaaacaaaataatgtcacctcatattatttatagtatataaagatgattttaagagtggcagtgtctgggattataggtgattgtatttcttcccttttgcacatctatgttctctcatttgtattgtgtggggagaagtgactttttttataaaaagaaaaaggtatatgcatcccagcagagaagcactggctccacccagtacctgcctcctcatgccaccctctcaagccaaaagccgggggaagcccaggcaccttgaccatgaccgcccgagactcacacttcttctttctcatcagggaaggaaagcccccctgtaagcgatactccagatgagggcgatgagcccatgccgatccccgaggacctctccaccacctcgggaggacagcaaagctccaagagtgacagagtcgtgggtaagtgggtcaccagcggcctctgtgcctgtgaaacctttatctctttgtatttttccaagacagtgatgaagggatgcaagtcattttatccattgtgttccctcaactggcatattaaagaaatatggcacaaagatcagcaggatgggggtcctctggtgtgtgggaggatggacactcacaggccagcatggccgtgagagccacacaccccgcaaaatgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctttgattgggccgttactgtcttttgacctttcttgtttgcttgcccttttgtttctttcctcctttttccttccttcctgtctttcttcttccttccttcctttcttcctttttctttttaattttcctcctttctctttctcctttctttccttccttctttcctctttttttctttcctccctccctccctttctttcttccttcctttctttcttccctccttccctccccaccctccctcccttcccctcgtctcccttcccctcgtctcccttcccctcccctccctccctcccttcctcctttttctttccctttcctccttccttccttcctctcttcttttctccatccctttcttccttttaacatttgatcatgggtaccatttcatcaagattctgttacttaggtccaaggactagtgaccaaattgtttttcccaggagtaaacttttctacaagacatagagaaatgactgccagtgccatcaggcacaccatcctgtgtgataggtaacctaaaataatggtacagcggggagtaactggaagagtcacaactacacaaatctcttgcattttcctgatcattaaatgaattagggatttcctggtttgagatttgtggacaaggagaactacttctttgtacaagaggcttgtgccaggagaagacacgctgtggttacaatgttactgtctctagctatggtcatttcatgtctttaactgagtgtacctagagtgtaatacagtgcagcagtgatgggctgaaggcctaatgcaccagcacacatgcctggaagacctaacgttgagaatccgcatttttttcatcactcacatttattttgcatctccctgttttgattaccttcagagacccaagcacttgcttttgtatatttgagtctgggttttattttccttttagaaatagtccaaaatccttttagagcctagacctttgaataaagtgctaacttaacctgaggaatgctgtttttttgttcacaaataaggcttaattgtgaagtcgtgagaattgctttctgagctgacttataaatttacccacctctttttccccaaacccccaaaaaatcctccagaaggtgagcccagcttgttgtaaaagattttgaagcagaagtcctgggtttaagcttcagttctctgccttaccagaatcgggatgtgtggggcaggcctacctcctctttcttcatctgcaaaatacattgaatgaaatcatattttttcctaagtatatgacatgtaaagtggtatttcaaaaactcattaatctgcatgaccaggtcagaaaagacacaccttttgccttgtgtctagtgtgtgactgtcctcacatgtagatgacccaggccacatccgctgatgttgtcttcctttacttctttgtcccttccaatgactcctttatgaagtcaatcagcagtgtttctaagccaggttccttctcttcacacatccccaacccacagggcaagtcatccacattttgcctctctattttttgtgctttgggaaacacattttacaacttccaaactatttgcctaagttcatctgagcacatctagaattattccactcctctgcatcagtgctaaaagtacaatcatgtataagctgttatactcccgttattttgtacctcatgtgcaggtagattgcaagttccttgcaggcaggtactacatctacttgaattgcttcacgatcacataacacaatgcagtgttaaaagtagaaaagtaattgacatcttgactaacagaaacactaaattcagtgtattgtgatgatacctttttaagagataggctatagaaatagaaaatcatcttagttggaattgaaagtcaagaagcaacattttaagtaagagatgaaaatacttaaaagggaaaggagcagtgcttacacagatgaggggaaaaaataaaatgtatcatctaaaaatttaaatcaaatatattaggttggtgcaaaagtaactgcgatttttgccattaaaagtaatagcaaaaaccacggttacttttgcaccaacctaatagatgggaaaaataagaggaatgaatattttaagctttgctatataattaaaatattcttagaagtctggagtctgtgaaggtcacaccctctggtcttctcccagcccatagggtataaataatctgaattgacggcatccagggatctcagaaattattagtacatcccacagtgaattaccaccttactaaaatattcatgggtatatactatggatttgttttatcctatttagtcttaaaaactataaagaaatctgcaggcttattaacatattactcagaatcatattgtctccaaagcacaaactgaatcagttacaagatattggactagagatcatggcaaatcagaggtacataagacctagttccgttgtggagctaaacaaactgcagagacctaaagggaagccttgcaccacactctaggtttggagctcaggttttgagtggtgtcagcactccagaacacatgggatccccgggaggtggaaattgagccgtctttggagaatcagctaatgagacagatgcatgttaaatgtctgttgtggcccaggcactctgctaggcagaggggtgaaccagaagaatgagattcatggggccaaagaatttgccttctggtgtaagaaaagatggaggcagcttggcagaaagaaaaaaaaggtaaaagatagaaatgaaatacagaataatctatctcctcatcccacaagcaattctgcctggtttgtggctcacgcctgtaatcccagcactttgggaggccgaggcaggaggatcacttgaggtcaggagttcgagactagcctggaccacaaggtgaaacctcatctctactaaaaatgcaaaaaaatttagggccgggtgcagtggcagttctgcctggtttgaacatctggttcagttaaaatacttcatgaaaatatttagcttgatgcactgaaatccatcactgcttttgtgggatgcactgactgcagtctgactgttctcctagtggaaaggggagcaatagcttctgtctgcatgtgcatgaaacagatggaaatttagaagagattctagtgcagacaacttcatcccacccccgctgcccacagagctagccatgtgcacggtgtgtttgaacaatgttatgttgctgctgtgcacagagatccccagtctcataaaacatactggatggaaggctgtcgagagatcatcaggccccagtgcataagttcttcctaagcatccttaacaggtgatcacctcgcctattgagaaccctcaggaggcagcccacttacggaagcactgattgttacaaaagccctgaactaaatctgcttgtctctaaagccagccctgcagatgtctgcagtgtaactactttctcttctctcaagcagttcagcccttcaaatcattgacaacagctctacaaagccctctaaatagcccgttctcctggctaaagtgtgttggtttcctcagcatatgatgaaataaacaccatgatgcctttgccttgctttttcttgctggtctcactcttccctggcattcttcaatgtgcccaagtccttcctagaacattgcacccaaagggccttcctggtctttccagggaatgcagaatgaaaaagaaatcccatcccctgcctcgaaaggagctcttctgtgtgtaagtgtaccttccccctcagggcataatgggaaacagtttgccaaagctaactgtgtaatttcacatgactcactgccgttagtctgagaaagcatggcatattaaactcattttccatgcttcccaactttatttactattccatttctgaggggcagagagctgagcaggaataacaccttccttgctcctcctaatggggcacatgtgcacatataaaattgtgttcgatctttgcagccacgacccatgttaactgtcaactgagaactcatgagtcagtttctcaggaacagccctgaagacattatctcctgcatcttgtatttgtgcctttgatatttggagggaagggtaggatctggcaattatcgttatctcatttggttcagtgtatttcatttcagcctgttaagatcttttggaaatactgtatgtgctagttacagggacagtgataaataagacagcattcctgtccttgagatgctatttccacagctccatgagatgcctagttaaaaacagagccttttttggaaacagcctactaatctgttaaaataataatggaaaaagataaagttagcatacctgagctgcaagggctgcctcctggtctgatctctgataaggatcagatcctagagcctctgagatccctgtcctccctgtctgcacaagcactcgcagaaggagaaacagtttacggtggttcatcatgactttgaaccaagcttaaagtcaaagtcatactctttaaaccattggaaaccaagtttttgcgagttgcctaaagtgggcaaaaatcccacaatgcacctgagcacaagcaggaaaacatgccattgtctccccaggagccctccttgacttctactttactttatccattgacactagtcttataagtagctttgtctgtccaatttttaattgaatttcgtttttattttcgtgagtggaaatatcactttgaaagaaatcagtcctctcctgaaatccagaattcctggagctcagtttacatgtttgacgcgtgtcacatgattccacaagtcactcaagggcaggaggattaccatcgatacggaaagatttcttagaaagcttaagtgaaagggaaaccagggagaaagtgtgcttcgtgagaataggtatgcggacggctctttgtgacgctctgtgcaaccctcgtgtttgcattgaaccaagctgtgctgcagatggacacccatcccatttccccgactcataccagggaggcccactttgcaaggtacacagaggggaccacagagcagggggccatgcaggggaccaagggacattttagtgtaaccaaagtgtgaagtatgccctttatttcaaaagaataaagaaaatcacaggttttcccgctgatatgccagggacatttccaagagaattccttttttgagagaaatctcctttgatatcccatcagtcagccatactgcataattgttagatagtgaaagaaattcattttttaagtttgtcagaaaaataaattctttgaagtcttaaattgttgcctccggacatgacatatctggctcttccagaatccatgttagtcctagctgaggaagaaggagaaggagaggggcgtttgttgattattgattttgtaagatgccccacacgttggctattagcagaattctcacttctaaaaggaaaatgagtgtgagctatgttcaatgagaaacagttatttttgggacattctttgaggtaaaacacctccttaagatgctgcttccttattgctatgggaccaagattagagcaagaacatagtggttttcagaccctggacatcatccacagccgcagcagaggccctgcccacttgaacaatgagacaggccaccattttgtttcgagaatgagcaaagtgaaccaccatgccagatattgttaagtcagcaactcttctgaagatggacatagtaaaaaataaacaaacaaggcagcacttgagatggtcatggcagagcaatctcaacaagcgatttgttattttgcacagtgatgtacccactcattgaataaaatgcaccagaaccatgcactacagatgctaaggagagttgtccttcaacaaaggagataggccccactggccgtggggcagtttatgttatttggtccttgtcatgggcaggcatggccctttctatgcttcacagatgaggaaggtccctggcacaggtccagtctccagcatggcctagaggtggcaggtgctacttagcatcgccagcctcctgcttggtcatggggtcagccagtttataacacgaacggaggttaatgaactgatcttcccatcgcacaactggtatgaacccacatcttctgattataaatcttttgctctttaactcttagtcattaccactgtctagtgtaggcctgtgtgttcatggcctttgttgccaccaaaagatcaactattagctgaataacatactgagacatgttggtgttgtgttctaaatagcactagtaaactgttagggaaatctgactatatagctactatccagtctagtttttcttgcgaagtgtttgttgagtgtgtaatgaggagtaaggaaggtgaataagaaatggcctgagtctttataaaataagcaaggagagaaaacagttttgatgagaagcgcatggaatttttagaagataggacgtgtattatgtacctataagaatgggtaggattttagaagagatggatggggaaaaggaacagggagtgggaacaaaacgtggaccaaggaagagcaggtttagccatggaagcctcaccgccggctttggtttatcgtgggccaaggggacagaccctgtggggagggctggcagcagggaggtcttccagaagtctatcctgcaggcagtaacagccacccagtctataagctgagtgggcatgggggtgatggggaatgggtggggagttattggggtaacttaccccaaaatgatagctagctggaaccatttattctattgcattttatcaataaatcttataggaagtaccatcctagtgaaaaccctgtcacattgagggcattcatgcttatgttttaaaacatgttattgggtctatgaaaaataaggctgaaacctatgagcaccctccatgcaaagtttcagtcaagactttggaaacaagacagtgtcttactcactttataaattcattcagaaagccgtaggtttgaaaattccaaacttagatgtaagaagctctgagaaacacatgaaatcacccccacatcagtagagatgtctcagcagacatgggaagaggggcagcagggtgtagggaggtggggcagccccggggtgggccttgcaggctgggcttgaatcccatggccaccaccgtccgctgggaggcctggagccggctgcccactctctgaccagcacatgttgatgctgtatccttgaagggaccgtggtctgacatcctgtgatgcagacctgaatccagcacccacagggtctgcacattccctctttgaggtggagcccagctccagaggctggtccctgactctgtttctcaagaagcctgtacagatgttcccctcaccactgtttccagtcacctttggctttcacggtgcagatgctaagtttgattttcagagcccatctgggaatttagtgaactgaacaggtagcatttctgaacccacccataacccatgccctccccactgattttgaaagagagtttgctgcaggtgactttgcagctgggtagagaatcttggggcaggattccgaggcaggcagatgagtgaggataaattgggttctgacggcacgttacaccagtggactctaacgacgacctcacctcgtgcacagataattctgccttgtgcttaaccgttagaaatgtgtcactgaagtgtgaacatattatgctgttagatttcccatcatttctgttctttcattccctctcatttgcattggttactcataaatgtagatctttggtatgatttgtacaactgccgggtgtcaatctgtgaaagaaatagcagagcaagctgggctctggtagcgctttatccctgcgtgctggcttgcccgggttgactcagaggcagtctcacattcagctgcgctggggccaaggacccagggagccaagtgtgtttctgttttctgtatttagcaatttaagacctgcgtttaaatactagctatgcattctagcaaaagaggtttatattttaacacagtaactcttaattgtttaattcagttcgtgtgttacctctcggaataaaatagtggaagccaattaactatagacttcattagtttggatttaagatcaccaaaacatttaccacatctcaattgttcattacatgctctctcttttttaatgcagtttttataatatggggagtgggggtgtggatttaaccattatatttttatgatattgggagtagatttaaccattatgtaaattggattttttaattttaaaaagtcacttatcttgatgtaaaatcatgtcttagtaaccttgataaactaagttttgcatgattacaccttaaggttaaaacatatttcatttcatcatttcccagaaggggcactgaattcacccatttcctgtttttcatctcagaatgttctgtgtttcctccatatctactttcccggcagcaggaccctggaagcagtcacaccaacctcatttaccccacctgagatttgtgcgctttgaacatagttgcaatcaaatcaacaatatctttgctcagaaatggatatgtgaagtaaaatgtgctgccctgttcatgtatgaaatcattcagctagctggccagtgagcccttcattgcaacaaagatttttctagagcccctgcactatctggggctatgtcaggcctcacactcctgctcacacgtttggaggctaccttggccagtattaccttaatccagcatttaggggaaggagcatttcaagactaaattttctaaactgctcaagcctacctcattttatttcttgtgtattttaacacttttggatgaggactcttcctagaacctactaacaattcccccccgcccccatgccaagattctttaaagactttcttgaaaacgcttcagtcttttcttcttagctcaaaagtactatcctaaatactagctctggcattacagggagttaatttgtgggcacacacagtaaattataaaccccttaagcagagaagattgtattatcagtttattagttttcttattcattccttcagcacacatttctgttgcctccaatgcagcagagaaattgacttctacagtttccacaacagtccagatttcaactgtgtagtgctctttcagccagaaagtacacttgtgtttccctggccataggtcctgaacctcacttctgaaaagtcattgtgcatagagagctaatagctgtaccctaaatgatcctggctttgaattctcttatctgcttggatagtattatctgtctcttcctctgcattctaatttgctacttctaatctgctgggaattacaataagaaagaaccatttaatcatttttacaactgtgcctaaagagagtgtgtgtaagtgccgagagagtgtatgagggacttgcccatgagtaaatgcatgaattttaggtcaagggttttttgcttctcttttggttgattacctcagagatcagttttactttctttctcattcttgacctatcatcactagctgatatggatgatgtgtacaacttctgagtaagaataatgtcaatgggacgggatgggattggctggtgattctgttgatcttaaagtttatatattttaagtttagtgtttcagaatgagaccaaagcggtgacattttcaacctcttcggtctctcttcagttttttcattttaagtttttgttgtgcttctatcacttaaaggaagcctccaagttgaaatcaaatactaatgacatttttatctaatgtataaatgtgtttttattatttattaggaaatttattttacttggccctcagccatgacatatcatggcataatcactatcctaaatttgtatatcttatccttgcataaggtaagactttctatgaattacacatatttgtattttcctctcttacatattttaagaatttttttatactttgttttctgcaaatgaaatattgctcataagccaggtgatggctgtccacgcctcttttcccctgcttacccttgcttagatcttatggtagaatcttttcatagaagacacagaaagacatgaaagaaagagctggagaagcctgaggggctgcccagtgagtggtctgctaggatgctgtgccacagcccaggcacaggaggcagggagagcaatggggcccttcccttccaccaacattcagcagaatttgcagctccatgtttccaaagcttccagggcacttgcatttagagagagagagcaagcaagctgcctttcctcttcctcagttctgccagccacactcttgccatgatgagcagtttcagccaaaagctccttcccctgccctaacacctcctgcaaggcctgaggtctggaagccacctgcgcctgctggcccctcctttcttgtttctgcaatggatgttgtggccctgtgagggagaagagaaaaagaagttgccctcctccctctatcctcacctcctgccatgctgtcacccttataagagagaagggctaaccatccaggctaatcctccagtgatgcaggagaggacatcctggccggaagagtcagagcttccaggtgagctcaggtgggtcagcccccgaggctgtgaagagcccaggggccagtagatgccacttttgctccaggaagaatcttcaactgtgtcctttttattcaaggggctctcttttcagcgaatctctagatgtactagtcacaaacactcgcatttattaaaatgtatccatgatcccacaatccttttacatatttctctccaggagtatcacatttctgagggccctgtgcctgttttctgcaggaagttgctgttgtcccgggtccccctgcccccagcacctctgttacaagaagcagacccttcatgccacactgggacccagggaggccccaagccaggatgctgggatcttagtaaaggttggaatgatgtcagaacatagaggaggcagaattccccccatagcatcatcctggagggcgctgatttgtgtgctctgccaggttcatctgtgactcaggatttaaaagccccaggtgtggtgtcccttctgtgcctgcaaggtgcgtctttagcagttctccctggtgtggaaggatcagtggttcttgcagcctaggcaccctccacagcaagcccaacacaggtgctgtgagcagctggttcatgaacggtgatcctggggagaagaggaggatgaaaatggaaaaccagtgcaaaggtgtgtcatccagttggttactgctgtgggtgcccgggcttccatcccaccagagcccccactagccagggcagcctggcggaggtgagcatcattctgctttctggctgcacctgtgtggacagagcccgttccaaagcctcccaggcacagggcagacatcaagcaaggggcagagctggggcgagggctctgggtgcccccgttattgaacacaggcctgaagggagcctaagaggtggctggcaggagatactacaaggcagaaagacagggcagcagtctttgtactgtacgtttttgttttttaagagagaacaaaaagtcaaggttgagagatgagaaatactcttgccaaaaagagaacaccaaaatcctggagtcacgggtcttccattaccctctctagcatttctgcttgtcttttccctagtattggtgaagaatttttaaagtaaccaacccataccgttggttacaggccctgtggtcaccaggctgtctccccatgatggggatggagagtggttagtgcagaaacttagacctcccctccagcttgttgaatgccctgaagtttatctagaagggaagatactcaagcgtaggatttcagtgatgcatttggacagcatcagtactatgcttcagcgtcaaaaacgtcactttgggtaggaacaatacataatgcgtggcaatgccttttgtgacacctgttcaggagattcccataggaagcttctgaggcagagtcctcaggtgaggagggggacaggcctgggtcttgggggaaggtggagatgaccagcctcatgcctctctccccagtggcctcagtctccatcaggcaaatcttgagaagcctcctccattctgcaggcaaatgactgagatgtgtgagctctgcttcccaacaggcggaaattcacatggggaagggcacctgtgaatggccttctagaactatcaggaagttctggatttagtaccctgtgagagcagatggtcctgggtgcactcggatgatcctgcctagccagctggattgcagagtggtcatcattatcagtgagctattgaggggttgagagcagtcagtgtcatgtataaggatgggttggggtaccggccaacgcccgccttgaggcctggccgccggatgggaggcgagagcacaagagagtcctggctaggtgtgccccgctctgcagggccacaccatccactggaaaccctgtgcccactgggctgcgtgctaagaggctgtggccaatgctcttgtccaaattttactgaatctgcagtctctcttaattcactccaaagtttaatgtgttagcttgcgaataaataaataaataaataaataaataaataaatggaaagaaacagtcctcagaaagtcccagtcaaattttaattccaacagatattcagcagtttcctctaagaacaatgagagttctggggctagccagtgtttctcttggaaaataaggaagagggaaagcggtgcattcatttaaaaacctgccctagggaggcagcgttccctgtgaactccgaggccacagtgagcagagcaggctggaggcctcccggctgtcctgcccctcctgccacatgcctgtgaaaatgctagataaggactttttctcagcaacttccacgctccttcagtggggatgtctttgactcagagctctgccactggttatctccacgaacagaaaatgccacagatgggttaattcactgtgttgttctcattttccctcagtttcaggcttttctctccttgcctgttttcctcgcttaaaaaatgatgtgggggtccctaaacgcatctaccccgatagatttatgttttcttttccattagtccactttgcgtctcagccctaaaattaagtttttgattataatgtaaggaagttttaccatattttaactctggctttttaaatacaaaagaaaaataacagaatggccttctagaactatcaggaacttctggatctagtaccctgtggggacagatggtctggagccagcgcacttggatgatctctctcagccatctggaccatagagtgaacttgttactgtccctccaaggctgacaactatgagctcatactcttctagcagtttaatttagacccaagaaaggctgtgtgtgtgtgaatttgtgagagtgtgtgagtgtgtctttgtgcctgtgtttctgtgtgtgtctgtgtgtacatgtgtgtctgtggggtgtgtctgtgtgtgcacggctgtgtgtctgtgcgtgtgcatggctttgtctgtgtgtgtgcgcacgcactctgctaagctactcaatgcaattccttactcttacttccctttctgtcacttctccataattctttgtatttcggttgggctggtatctcgcggcggcttcctcttttcctgcattcctatatttcattatttgctcttgttcctcttctagggcttttacaatatagccaggaggatgtggaaacccagttacaagatgacacacaagcacagtgtcacaatcgctgtgcttgggccctacctcctggagaccagggtgggacggtgtctctggatatggagggaagggcggaagatcacggggtggcagaaggcccgactgtccggtcttctggaagctggggtctcgtggtcgctgggctggtggtgctctaaaacctagagtaaccgagagcaggatgactgcacccctgactgccgactcaccgggcttcggagggccatgggtgtgtgattccacttgtgatcctcctacttccccagcccaccctggtggtctcccacttctctctctctgcctgtggagtgttataaccgactccttcttctaggcatctccatcccaaccccagaccagttcccttaaaccacctcccaccacaggacccccacaagcagggacctctcacagttcctgttgcctggggacttcatctcagcttccaaggcctctggaaccaggccctgcatcctgggcatgactgtccccatgattctctgagccagccaccaccccaccacccccccaccgccaagtccactgctgaccctgctgtagccccccacctccacttgttgagattccctcttcctgcttctcattttgaatgtcacccttctgtgacttctcacaacccccctgccacccctccctccagttggcatggcttagtcttcctaagaacatgtgctgcttcccagtacccagggctgctgtgcaccgtggcacgtgagtttcggtgcatcttcctcctgctgtttataaattgcaacatccctggacagatcttggattttccctctataatttctctggagactccctcggggtttgcacacacatctgtggaatgcccaagttggagatggtcctccctgatgtgtagtgtgggctattcagagggcctcatttcataaactcattaacagctaggacgcgaagacttggagaagttagctcaggacacacggagtgggagggaggcaacgagttaagaaatgggctttggagtgcctcgaatttggcctccacttttcttttctactgtcttacctggtcttaggcaggtcgggtgaccatctggagtcggagtttctctcatttgtaaagcgggggtgatatttttctcacagggctgcttcaagggttaacaaagttaatgtctaggaaggacatagcatagcaccttcacctggttgcaagcccctggagtcacatggcaacagctgtggaaccaggtaaatgacttgacttacatgttacacgctcttagttgttcgatttgtaaatgggaagagtgtgtgacccaaattagtcgtttccagatatttcctggtaaatggttgttgaatcataaaactagaaagatgggaaagaaagggaggaaccccccttacttcgaagaagtgttgttgatgtgaaggacaggactttttgagacactctcatcctaagaaacagctgatatctactaggaaaaaacatgacatttgaagtttcttcctaagagatgtgaggttttgacagaagtgccaggaagccagaggtgtgtgagtagtgggccaatctcgcgtgaaggctgtgggacggggcaggagaggggcagccagcatttcctgagcgccagctaatggcggggacctggcacctttgctctgtgactctccagctgtatggtgacatgaggctggcgttttctttggtttcatacgtgaggaagctgaggcttggtgatgtcctgtgcatggctcggactccagagctactcagaggcagaggccgtctgtaaacaccttcaggtggttggaggcagggtgctgcagccaatgctgatcactcacaagccaaggctttattgtaagggctaaataaaataacatatgcctagcatttatacagcacggggctttttaggaaatagtgagacgaccatggagaggtggaggaagagagaagggaaagaagaaaaagaaaaaaaaagccttaaagagtttcttaagagaactatatattacaaagtccttggagttttttttccctggttagacataagtttacatgaaacgttaaacggcttaaagtagccacatctccttccttatgtcttctcacagccacttgtgagtttcttatcaagatacagaattatggccaagtgcggtagctcacacgtgtaatcccagcactttgagagactgaggtggaaggatcatgtgtgctcaggagtttcagaccaacctaggcaatatggtaaaaccctgtctctacaaaaaaatacaaaaattagctgggcatggtggcatattccaatagttccaggcactcgggaggctgagacaggaggattgcttgagcccaagaggtcaagactgcagtgagctgtgatcgagccactgcactacagcctgggccacagagcaagatcctgtctcaaaaaataaaataaaataaaataaattctgcaacaagtcacaattccttgctcagaaatctctacaggtgtgcttctttgttaagaaatggaggaaacatgaatttcatcctgacttctgagtcttgtagagaccagatctgactcctgcagccttctgcccacagagctggcaggcgggggaatgtgcgcagagtgaggaggagctgatctgacattccgaacagtggagactgctgcctatttggccgcaccactgtccttctgcatggaaaagtcacagtaaataatggactctctacctgtgagtcgattttactgagctgcctttttaaatatatgtgtagaaagggcgatctctgtgtgtcatttgcacatgtacatacacatgtacacacgtgcacacgtggtcactcatgtacacatgtgtgtgcaccagtgcaccagaccagatgcacccacccaattccacgctcctcagccccttgctttcctctgcagacagccagttcagctacagttatgccagattgcctgcactctgatctttaccatcaccagactctcagcttgagctcatgcctgagaaatccactttctgggaggaaggcagaagaaactgccaaggcaggactgaagacttgacctccacctgtagtggggtcaggtcaccagaggctggctgactccccaggatttctcagcagagtattacacaaataccccttccttaaagattagcaaccacttaaagacacaaagtgtgcaggactgtacccatggccgagagcggcgggattaagagggcaactgagttgttcttcccatccctcctcctctgtgctgagtcaccttctgcttggaattctgacagggacccgttgggcttctggaagggagggacagcagaggatccaccctctgtgtgtcctgggggagattacttatctctggcctccctgaagcagggcctgggcttctggaatctttgaggctgacaccctgccagccctggggatgagagggaatggccgtgtctgtctgcagagcctgaggaggagctgagcacagcctccagagttctcttcagttgatcgcttaggtggacaaaggccacagaaatggatttaaactcctcagccctttctttgcatgtttgttctcatttgaagtcagaagtgatatgtcctacacctcaagaacgtgtgaaatgcacatacaataaccccatttcaggaagccaagtccagcttaacagtcaaaacatttccttcagtctttagtccttcactttgccgaactcccttttacaccggcagcaacagtttaacctgttgcttctgtaagagtgtgctactgggaaaaccacatctaaaacacgtgtgcagttacatcagctagagcacatgctaaacagttgatcaaaggctcttgccttgtggcccacgctgcagacactctgacgactgccgagctccgcagccccatgtcgtcccttccgcactgcctgctgtgcctctcctctccatgtggcagggaacacagccagtcatcaccatgtggctctgcccggcgctgccccagcatgtcctgacagggcctagatatggaaaggtggctctccatgcacacaccccaagcccctcctgcccgccgtgtgacccacactcttatgggcagcccagttattttgtagcatttcccttccttatcattttggcccagtgatccagcacaaatctcccttattagaataaaatttggaatgacaaaattaaatttcatttttcacttatattgaggacctcacactcttcacccctgccacgatccctgacaagagccttcctatctaatcattgttcctccagccctcttagttttcttcagcctttcttgattgcctgaatgtccctttcccttctccttttaaagcatgaaccaagctttcttaccccgttctcattatcatttttgcattttcttctttgcatatgattctccttaaattataaaacttgggggtaatttctagaggtgccatcatagtgcttctgtctactcagtgtctttagaatcagcaaatatcatttttacaaaaaagtagtatttcttccaaaaaagagtaagcaagaaggttacaacactgggaaaatatccctaagcctgttcttcaacctgttgaatgttttcccctaaattgttatatggagatcctggacccggaagttggctgacatgaaacaggcctagcagggcagctgaggaaatgctccaacctcaggatccaggaagattgcacatggcaccaaaacaatcatttaaaagctaatcctggccaggcacagtggctcacgcctgtaatcccagcactttgggaggccgaggtgggctgatcacaaggtcaagagatcgagaccatcctgaccaacatggtgaaaccccatctctaccaaaagtacaaatattagctgggcatggtggtgcgcgcctgtagtcccagctacccgggaggctgaggcaggagaatcacttgaacccgggaggaggaggttgcagtgagccaagatcatgccactgcactccagcctggtgacagagcaagactccatctcaaaaaagaaaaaaaaagctaatcccataaaagaaccatcattttgaacctgctgtttcctttcttgtactctttagaagtacccatttctccctttctaagccataggtgtattaattggagctttttctatcttaattagttcactgtgaacaattaaaattgtgttaataaaacaaaaacaaaaataggactggtgcctagttgtactacatgaagagagaaagggccagacattggtttttcctaatcttctgtcaagttctccaaatcatctgctctggaaggtagctccaacagctgggatttgaagtaaagcatagtgactttggccatcactgacatgtcccatttgaagcaaccaaaactgtccctcgacctgacactcatccctgaaacaccatgagggtaagtgaggcgcttcggaaggtccactcaaccccattgccagatagagtaagtgtctgccaggggcatttggagctgaagggaagactgtacagactcacggtttgcaggcactgaaggcgttttcctgccttctttttcaccttcagtggacttgcaaagcactagccctattgtttttcccatctgggaaacatggtgaatgttggttggttgtagctaatcctatgggtcttgaggtctttgttgacaagaaggtagatgttatctttatctgcgtgtggctttctactaaaacatgagctacagggctctcttttttgttttaaagcatttttccataaggttcacccttactattgcttatctgaataatattacctgctgagaagtttattcattgctcaccagttgtagggagattttgacacaggactggaggatttttttctcatcgtaacagtgcagacccatggaaagcttggaagcagttgtgaccggataagagcaggttgaggatgataatcttagggcaatgagcaggttgattgagaggggtgcctgaaagcaaggtccccatgatgcaagcaaacaaactcacatgccagacggtggacaggaaacacaggcaggatgtggtgcaggctgggctgccttggctgggcaaaggcaggggcttcatggccatgctgggatgtgacgtggttggaaaacaataagaatggagacctctccaaagacctcagacataatttggccatgagaggcaagggtagaggcgagccccctgtgggttggaatgtatggaatccagatgaagcaccatcaacatgcatgggctacataggagagctgggtctgggggaaaagatgggatttgggtttgggtgtgcatgttccaggcatggagggaagaatgggcagaatgacgaggatcaagccctggtggagcccccagaccagggccctgggcatatttccacttgccttcttctgcaaacttttgtgtgcctgttgggtggaaggtactatgctggggccatccaggatccggagcagtgtaagacatcatggcctgcatggtgtgacccttgacatctgaaaagaacgagctggtggagtgggaaggagacaagtggcagcagagttgacatcatcaggactgactgcaggacaggcggtgaaacgagccactgaggagttacccagtgccctggggagcttagatgtgagacttacaccacccagcactccccagctctgtgtccctgggtcccactgaacttgattgtattttagttgcctcttttctaagaccggagcaacaataccttccttgagtgtgcatgtgcagtccatagatggcagccagtgttctcttcccatgagaagactctgagcctcctcactagagggtggtctaaaaacaaatggatccatccacagaaggtctgaaaggttttcatagaatcttgacttggtagcacttcaggatctaactcgtgctttccagaagtgtggcctgtggtgttctgtctggagtatttggtcctcccatccacctccaccttgctgtcctgtcctgtgactctcactagctcagtcaccgggtcaggaagccctgccatgaaatgctagatttggaggcattgccaaggtaccacaaaccatactcaaacaaggtcataatagactagtgatctcactgtggctaacaggttcatgtgatttaaagaatgacagcattttttctaaattttataaattttataaatttctcctaaatacaaatctgaatgtgtttacctttagacagattttcccagaaaattgtcagtgttctcgaatttgaaagtagatcagatctcctccctctagttttgaaaatctcaagtaggtttagcctctccccagagtgacaacggcacaagaagtttataattttatgcacagctaaatgcaaactgaaaagtgtggtttgtgggtatttcatttttcccataatgttcatcaatttggcaattcaaataggattcagaatccaaggtgttcgcagcattttatatgaaaatgtgcctgagagtttggggaatagaaattcttaccaaataagttaaatttgctcttgataagaatatattttgtaaaatgtagaaaactgagaaaaaaagtttgacacctgttttatctgcatccttttattaaacagtggcctgaatttactaaaggacagagaacagggttgagaggtaatcactgaataatagcttcgctaatcccacagtgactgcttcttatgacaagcaagagggtcaacttagaggcaggactgtcttcaggggcaaaagcaagtcagcacctacaaacctctccaagagagtgagaaaaagcaggttgtatggctcattttgcagcttgccagaagcaatgtgggaatattgtcagactgcacagacctggggccagctggctcctagagtgcgaggagctctcagtgactgctgtgcatactcacctgctctgtgactttgttcagtccctaccctggatgtgtggtgaagggtgccaggcttagctgctggaccagtgaggtccctgagggggcagggctaagaggtgtagcagtcgcacttgaccagtcattgattcactggttgggaatttgttcattgaggggacaccattactccccatgcctcacgtgcaggtgagtgtgtgtatatttgcattaacacacaaacacacttatgtgtgtccctgtatgtgcagctgcagtaccttacacatcttccagtgcctctcaagcatcataaaaacagcttccacaaaacctctactacccacctggcatccacagagctcccagtgattggctcccaaaagatactgaactttggcatggaacagagtgagtttccacatttgctgttgtacataattacctgtccagctagaatagtacacacttcttttactgagcccagaagtttatgtgcctgaacacggatggtacaggaacaagggtgagcgcttatcaattcagcattactctggagacatgaaacaaactaataggtacagctatattttgttttttaaacaattttgtgaaccacatatttgggacaaaaatcaacaagtaaatttgaattacactaggcaaaggactgattcttttgaaacgtgattgacattcaacgtctaactttccaaaagaagacatacatgtggcccacaatcatatgaaataaagttcatcatcattgatcattagagaaatgcaaatcaaaaccacaatgagataccatctcacaccagtcagaatggttattaataaaaagtcaaagaatgacagttgctggtgaggttgtagagaaaaaggaacgcttatacactgttgaggggattgtaaattagttcaaccatgtggaagacagtgtggcaattcctcaaagacctatataccatttgacccagcaatcccattactgcatatatacccaaaggaatatgagtcattctaccgtaagacacatgcacgcatttgtttgttgcagcactattcacgatagcaaaaacatggaatcaacctacatgcccatcaatgatagactggataaagaaaatgtggtacatataccccatggaatactatgcagccataagaaaaagaatgagatcatgccctttgcaggaacatggatggagctggaggccattatccttagcaaactaacccaggaacagaaaaccaagtgcagatgttctcacttttaagtgtgagctgaatgaggagaatacatgggcacatagaggggcctatcagagggtggagggtgggagaaggaagagtatcagaaaaaataacaggtagtagatttaataccggatgacaaaacaatctgtataacaaacccccatgacatgagtttacctatataacaaacccgcacatgtactcctgaacttaaaagttaaattaaaaaaaaattaatgtctaataatatattacagtattcttcatattcaatggcaatgtgtgaagtgggaagtgtcttgacagaattcggtgtttcaaggcttacactttgatgcccaagactgcacaaggctacattttctactggtgagacaaattccagacgcattgcattcagatctaatctcttagctccttaatcttcagggtactggtaaacatgaagacctccccagtgctgtagtcatcatgatatgtacagcaggtggctgagctctggatgtagactgcagggatatattaggaagttaattctcaaggcaagtcatcttcaagcaccatatcagcatgatcagcaatataagtagtatctcagtgctttgttgtttagtcagagttttgtactctatcacccattgtaatgttcctatttgcaaaaggtaatacataccctttaaaacatctttgctttttctcccattatcgagatgctagcagcttcataaagcagaataactaagggcaaacagattatataaagggttggagctcaatgaagacaacaagaacagcaaaggttattgtaaaactggctgcttgcaggccaacaagcacatccatatggaggcaatcagtttatgctacctctgtctgtttgatgggattcataatattgactttatccattagatttggactaccagggaataaaataagcagatggagagtaaggatttgctaggaaataattcagccagtcactttgaaagctgttcaagaaacagctttcaaagtgtctctcaaactatgtttgcccattatcccaataatttatttcccaataatttcatgggaaaagaaggaagttctgtggtcagataaatctggaaaacactggtttaagcaaagttcagtaggtctgcttccctgcaggtcacctcagagtctttactctgctaacctaggaactcatccaacaagtttaatttaacagctacactgtgtacgtcactttaacagtcactgagctgtgactcttgggggaaagattgtgcgtgtgtgtgtgtgtgtgtacacatgtgtgcacatgtgcagaatctaccaaatcttaagagaaaggaacatgctgggaaactgtcctgtgaaagagaatagaaacctgaagatttgaggcagtgatagcatttatgaaagcagcagataaggactaatcaccaaaaggggtagctcttttgttggttggggaaaacaggaatttttcccccacccaatgtgctgcattttctaattttctatgaacacttcctaagaaaaagctgaatgaagaacatttgcgatgcaatcagctcattaagaaacacgcacttttgtggagatacgtgctgtcccaggagatgctctgcgaggagccgagtgtttggactggagctgctgaatggtttctcacagttctagaatgtttggggctgcaccctctaagatgttgaacccatcagtaattgctccaaaccactttatgggatataatgctgtgagttgacacctgaggggattgtggtcctgttcatgagtaattacttttctgttgcctatagaagggccagcaatagcagatgagtagctgaacagtggttttgagtaataaaacgttcttttttaaaaaaaagtaatgctttctgttaaactctgactatactctctcctggtatcacaacccagctttctttttgccttctttattgcagttacatatggggctgatgactttagggatttccatgcaataattcccaaatctttctctcgtaagtatatgccttgcttctggaaaacaaaagcatgccttcatctcctatcatgtaaatatcgtacgtgcatgttccttcatcaacccccgagatacattaaatattcactgttctattcgttagacacctaccatatcatttttgggtatttataccataaagtgcaaaacgaaggtctaggcagttgtgcggtgtcctgggagcatggcagtggagtaacagtaagggttggagtcacagtagcactgatgggattgttacttcgcagatgctgctggacagctttgagattactcctgtaatcctttttattgagtgtgaggataaaatggccatattttctgtcaccaacaaagaactgaacatggtttcaagataatttttacaattttgtgggacaggagaaggagatatgctcttcatctgtggttctggagtattaatttcagaactgagaagagaaaattgcaggcctccaggccgttattctgtggtgcatcgctgctggagccaacgtactgttcctgcttggtgcccgcaggaccttctctgatctgagctgttaaaccaaaaacagatgtgaatttcatttttcttttttagatattgagctgataaatgataaatatatttgggtaacatcctcaaatgagtactttaaagaacagagagtgcttttgaaaatgtatagagagctgaatatttaaagccatacaagttgataatccccttaggacctgtattagtaaatcctctaatactataaagcaacatcagaaaacaggtcgcatttgttaacactgtgacaattataattataggctctaatttgaacagtgccagtaacagttaaagacaggtgtctgacatcctggttatcaaaaactatctggtgtctaaggaatttaacagtatcaaagtacatctttttgctcacaaactagattggctacttttccagcctatagaagttacagaaatctttcttttactgatattcctttgattccactttaaagcaatagcttgatacctactttttgagatgtatatgtatgtacttgtaaatgcttatatatgtgtatttgtttacacgtgagcttatatgaacatataaaacattatggtattggacagagaaatgatattgatttgaagaatcatattgttgaagtattttgagaagtcaaatgcacttgagagtaagctaatgcatcctaaaacatgtttctgtgaagtctgaggaaggtgtcagccagagcatatgttgaagcagacccttcagtgaagccttcagtctgtaagaatcgctgcatgtgaagatgtgttaatgttatgatagttacagtttttataaaagagatgatatacacttggatatgctttctgtctatatttatgcaaatgtgtccataaggtattggtgtctctctttctctcccactctccccagtgttggaattgtgactatcttctcacacaagcggctacttggtcttgatgccttcccccgcaaaacagcaaccaaactgttctgggccaatatcaccaccttgtggtcatgatgaagaattgccccctttgccctcaacacctcttttcttcttgaaaattaaaaacaacccctttcaccccctctactgtccttattccagtttgtgtccgtagttgctggaggaaagaaaatgcctattgctcttttttttattctctttatctgtttactcttctgcctttcttttctctccctgacttcattccatttaaaggccttaaattgcaaataacgaaaaaagtattttctaataatataccctagtgggacgaaaacaaccttctacattttaaatgatattaagttataataaatggttccatgaactttaaaacgcttaaaagttttataaatctcttttagaggcaacacaaaaatatctatatatatatcttctcttcacctcaaattttcatttaattaccgtgattcaagatatatcttaaatatttccatttcatttgatttttacttgctagtcaccagtgttgcaagaatatttctgtaccatttttcaagtaaaatattgagcatttcaagcttacatggcctaaactcacactagagtgactacttcggactatcttttcaatggaaaaatgcgttctgagtaccaaacatttactttttcagtaaatatgaagacacattctaaaaaggaaagggaaatgaagaggaagcttaattcattggtcaggtggggactaacagtgtacattatacctatgcattaaaaaatgtttaattatccatgagcacatacagtgcctggcacagattcaggcctcttggctcctcttggcatctgagttccttggattctccagattcttcaatccaaacttgtctatctaccaaagtccaccttccatacaggggtgtggggtctctcttagtactgttgggtgccaataacatagaagccctccaagataggtcaatgagattttaatttttcccaactttaaatagcatctgggaaggaaagcagcttttgactaggagtttgaaaacatccactcttcatatttattgtcacatttattgagtaataaaattgggctcttgtccattatctctcagtcaatgaaagagcccacggtgggcatgagccagagtgttccggagaaagagaggaccagtctccatttcatgttctatatttaatcagttcaattcagcaccttactgagtttgacatttttctaagtaatggggtggggggttacaaaatatttataactatctttcctatcttcagggagatgtaccatttcactgaagcaataccacagctaagcagttccagctccgagtaacagaggaaggagtgagcgatttaggaactcacagaagggcacggccaggcaactcgggccctggcaaatgttccatagagacagcatccatggggttgaaccaagcacaatgcctgcaaatcgggcaggcgggttcatggaattgattctagggcaggtatgatcagcaccatttaaggagtggcagttgttaagaaactgaagggatttctcatatggcattttcaacagaattcagcaggagccttgcatatcccttgggatgggttccggggtattatggagctgccaggaggtgctcagcttcagtaagtgccagtcattccttcccaacctcctccttcattagtggaagtatcagctggtgtcattgccttcttcaggaggatggatttcaaaatgaagggccaacaaaactcacattctcgcagagcctccgtcacaactgcatgtgttcactgccatcaacaggccaacacccacttgttcttttcttctaggtaaaggaaaaggtctgtgggacaaaggccctgaactcctcactccttgaatgggaggcatattggtggaggctgtcacacaactacaggtggcaggaacctgccatcagggttcccatcagcctccagggcttgcttctctgccctgtgtgtggacaccttccatcactggaaacccctctctcagaagaaccacttcttgccctcatctcccacttgcctctcctcggcaccttctccaccctcaggggccaagctgaggaagtgtgcatcctgtgccaccaaccttgctcgcaggaattagtttcagtccccagtgactgactcttccaaacctgcaccagcctatgctgcccttttgaaaggaggcgtgcgtacagcctggctggtacagaagattccagatttcagtgactacaggacgctgtcaccccttctgtttttcttttttctgtccacatctctgattgagcataccttcagggaaaaccccagaaacctttttcacacttacatgggaagccaagacactctcatcctgggcttgtgtttttaaaatctatattttaatttcacaggtccttacatttatgactaatagatttcagattttgagatacaatctgtagttgcaacttatgaagatagtttcaagccctgatttctgtcatctatgaaaacagtaagcaagttgcttgtattctcctcctagctggataagagacccccgttttcatggacagcctccttgggtggacagaagtctcctgatcttgtctatgtaaccagcacccactttgcatttttccgcaaagaaaagaggagcttaaccccatttacgggaaatccacgcactgcttgaatcttacgcgccccgtggtgacggtgttgcccactctgttcccttcccaccaaatcctgccagcacctggcagtcatccagtccttgtcttagacttcaccaacctttcccgtcataacatggcttagaagttgtccgaatagtgctagaagctttcagccctggaatgctcagcatctgccatctaacttccatttaaaacgttttgagcatttgctgatacaggttcctctgtcctttccccattattttcagttccttggccttgcccatagtgatctgtggatattgtctgcatactcttttttagaaacctagagcatcgcagtgtccttaattttcctcttcaaactctatatattcctgagctgatcatccctactgctgttcctacagaactgtgtgactaatcttctatatatgtccctacatctagccatctaggtggagatctaggtacctatctccctaaaattgtacttggtatccacattgacctcaggacagtatgtgataggctcttgtgccttttcgactaggagtttgaaaacatccactcttcatatttattgtcacatttgttgaataataaaattgggctcttgtccattatgtctcagtcagtgaaagagcccagggtgggcctgagccagagtgtttgtgtccctagttctcttttggttctgttacagctctcagtgacagtgtcattgaggctaacaaggacagagtactgctttcagccaccatttgtccaatgagtggctgatctccaggcctctggctttgagaacatctgtgatatctaaggcagcatccattgtgggctttcccccatgcttctgtttccttcctgtcacatagctttgcctcctcctgcaagcagcctgctgtagcagaaccggtgttcctgaagccagaaacccaaaggtcgtgtccaatgcttccctgctgttctgctccccacctgcaagcgcccacacactgatcaacagcacacgccatagagcatgccaaagaatcccagaaatactcattcttaatgatccagaagaacaagtgatagcttctggcaagttctaataggccatatgtgcccatgggaaagcaagagtcaattctctctagctggttgcctctgaatttatgaagtcaagccgcgtaggggaacatgccaagaggattatcccaatgcctgttctgcgtggtgtcctttttctagcctcggaagcactaggcctacaccttcgctatagccctcgtcttagcgcctgtatttgaaaaacttgccacaccaatcttaatttgctccattgtgttctaatctcattttaaaaaccacaaggtaaatgattaaaaataatcttagattaaggagtacacagatctttgcagcctcattgtgtttccagagcgggctagtgtagacactggtgaacaaggagggcctagagaattagctttctcccagaaagatgcacagcctctacctgagagtaccaattccagagaactcaatggtcattaagcaccattgcctcgacagccagccagcctcacttgcctgcctatctcctttattttccaagtatcttgtccctggcagtggggagaggttagcaggaggctgctcagatgctctcggtctctgatcttcaggatctgaaggggagagcatttgaagaatccccattgctggatttctcaggacaatcctgcataatgccaggatctgatggaggagacaggcagctctgttaatcctctggtgcatcctcacttctgtggtctccaagtccaccatgtcccagttaattcatttcattattcatctgtaagtcatttccctaaagagctaataagaaaacactggcagtacaatcagccctccatatccatgggttcagcctctggaaattcaacccactgtggcttgaaaatacagtattcaagagacatggaacctgtggatatagaaggcagatttttcgtatccataggttctatagggccattttagggacttgcacatctacagaccttcaggagtctcagaactgatgcactgcagataccaagagatgactgtaagtggttaggaatttggatgctggggccaggctgcctgcagttaccttccagctctgccacttgccagctatgtgaccttagcaagttgttcaacctctctgtgccttggcttcttcaactgtaaaataggataatgatagcacttcccttatggagtccttgtgaaggttaaatggcagagtacaattaatgtgctgtgtgcccagcgtgtggtattggggttaggtgaaagactgtactgggatcactgggggtgagcctccatgtgccatgccccaaccactatcctcagctaacttcttgtctgtcagtgttaggctggtgctataataatttccattttcatggatgaggaaatcaaggcacagagaagttacatgacttgcctaagatctcagtgcttttaaatagtgcagctaagattccagaccaggtatttttatttcagtgtctggactgtagatctctaaatcgagaggaactccctgaataaaataagcttggagtgctgttaactaagttggttatttaagacagttgttctcagtcctcagtgtacattagaatcttctggagggtatgttaaaacagactgctgggcccaccgagagttcctgagcctgcaactctgggttgagcctgagagtctgtgcttctagtaagttctcaggtgatgcttatgctgcttctcccaaattttgagaaccattgattgaaaatgttgatcaaaaattatgtggtctaggctgagcacagtggctcacaactgtaatctcaacactttgggaggccaagtcaggtggatcactgagctcaggagttcgagagcagcctggtcaacatgacaagacccatctctacaaaaaacaccaaaaaaaaatggctggatgtggtggtgcacacctgtagtcacaactactggggaggctgaggtgggaggatcacttgagcccgggagacagagcaagaccctgtctcaaaaaagaaacatttagtcttgattgtcatctatctcattgatcattttacttggcaaaatttacctacttactcttattagtctgtaaaaatggttattaaaatggtggctttcagtgtaactacaaattctcttagtcattatagtgttggattcaccaatgtatcatcagtcagtgtttctgaagtgtgtaaatgaaataactcctactttctttaggaagaaaaatattcaaatgacataattaccttgtgatgtgtgacttaaaggtaacagtaatgcagagtcaatagtggtcattgtattcaagacactaaaagttcacctcccaccccccccccccacccaccacccaacaaacacacaagcttctttccctttggaaaaaaaagctcttccagatacctacattcataaactatcccaattaacccttcagcaagtggaagaagtgtaagaaaggatacctcttctttagaacacagggtttgtttttatgttatttaagataaacaggaattcaaatggtcatgtaccaaagcaacacaaagaacttccggaaatctgaaagggaactgtggtcagaactctgagcatttttatgtttactgagttttgtcccaaagtttattaatgtttacatgccacaaggaaaggtagcatcacaataagagacgtttttcaggcttgataaccacttattaggtattttgccaaacaagttcacacatcctagagagctggattgtgtgacccagaacccaccctctagggcaaggtgcccatctgatgggtagggtgtaggagtaggcctcagaccactcctgacgtgaacctgcttaaagtgagggcccaattctaaagtgggaactatgtaaatacctttctagtgcattttcagataatcgccactgggcctatggatggagagggctggcagatctccctgtaaccccaggtgcatcccgaggcctgccaccgaagcccactcaaggctgaatgcacggcgagctcaggctgctctccccttggtatttgctaagaacttctgtttagtagctctccacacctatttgattgtctttttgctgctgtgttgttttgttgagttttttttttgcaatgacactgagtggcctcctgtattgtttctttcagccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggtaaggcctggctcagtttttcctttagtggcctggagaaggtgcatggggtttgaaggaggaaagcatcctgtcttccttgtgttctgagcatgtttctaattgactggtagctcagttgttgcaagcgattggttccaagtggtaccgagtcatagagtccttgttctggtacagccttgtaaaggacttctcaacacgtaccaattccaccctataaataaaacaagggaaaagtgaacagcatcacatgagaggcttggcgagggctgctattatagtaacacatactaagtagtctcagctgagccctcagggtacgtgtgctgagtggtcaccctccacaaaacaaaaaatcctgatacaccaaaacttactcctcaaagtttccactgagaaaccatgagtaaaatgtgtgtttaaattgtatccaaactaacagggtttgatgtttagaaacaataatcaatgatggaatagcagcaaaatcgagttttcagaaagacctcagatgagctttcaaatggcttgccctctaacaggaaagactttgaatcagatgcttctattgccactggttatcagctcaaattcctaaagaacttcatcccaaataccctgtcttgctgaaaggtttactggaagtataagagaatgtcatgttctgtgtccagaaaggaaggaacacgggcaccctagtgtcagcgagttgtgctcaggctcacaggatgccccctcaccagaggcgtgggaacacggcgagccccagctggccgcgctctgccactgtttctaatagccggtcacgttgatggaagtgtcacagagttgtccaacagaactgtccagtcagaaaaccaccactcatggtgctggagtgtcttagaagtaaaatatgaataacacacacttatttaactataggcaggaggtttcttatgaattgaagagaaacttttctttgcgtgggaagctgttctaaagttgggtaaaacacaatagatccaccacctctagcagccactgatagctgaaacgtgaaacatagagaccctaagctatcactgcctctgagctggcattgttaggtcatcataaagctagcgtctcccactgcaaaacccaagaggaaaaaaatagttgaaaatcctattttaaaggcctagcagattctataagataccttgggaaaatgatgacgatgacttgaaatcagaccctcgtatgctgcttccgtgggggcgaacaaaaatatgttcatcaaaaattaagcagaaatgcagaaaattttgtgagccaaaaaagctgtgttatcaggaaatgcagatatttgtggggttgtaattttttatatttgaatcgggcggttttcaaaatgatctattccatttgtagtgtatctgaaaacctataaaaataagttgatatcaatagatatccatcttccataaaaattcaacttctaaaattaagcaaactttgctttttctaatggcccctttatcctcaaattacccactgaaatagacggatcacactcagccctaagtgaagcaagcgtgcatgagagtagtcccagcctcgcctttgtaatgaggtggaaattaacatgaaggtaggctaccctgtgatagacacttaacaggatactcggggacccatggtaatacatccctgataaggaatagacctcacaaatgaactacttgcctgttaattcatttaaagcctgactgtacagtgaaaattctcttaaataaatatttgataagtgaatcaaattctggcttactaaattgccaaaatataatgactgcctgccttgataaaaagaataattacatttaatgaataaacctgccaagtacagatatgccaggtggcacctgctgtttgctgctcacttctcccaacaaatagcagctaggtgccacctgcacaccaataagctgagtttttcacttacggaacaaataactttcagaagtcaattttatagtttctgccttgccctttgttaaaaaaatacacacacttgaagcaatgaactcatgaattgttttcatcatgcatttccacttgcctaaatataaagggtcccaggtagatacagaaatacctggtttggccaaacttggtttgaataactagacatgctagaaaaggttttcattttcctgggatctgagtggaatatgttagaaaaggcatgctttctgaattctctatgcttaaaacatttctagagcagtgcttctcaaacttgaaagagcatgtaaatcacctgagatctcgtgaacatacaactctgcttcagacctggggggaggcaggagagcaagcattcctaacaagctcccagcttgtggagcacagagccgcctcaggcagcagggcagtgcagctgagcagtgacagtgaacagggccattcagagggctctccacctggggcttaggtacgacgggaatccccactggacaggctaggacttgcactgtggccattgttcctcctcctgcccatggctgagtcagcttctcagtcccttccaggatacactgagaggattcaggggcggtctcgcctctgcccatatccccacgttggtgaagtaccactggcgccattttctaatcagctcatcggcaccagcacgtcacttcccctgttgtgcagctcagttttatatttctgactcgggtgtaatagtaacatcttccccaccaatgtctcagggttattgtgagaaccagagaggagagaggtaggaaggaagcaggaaatgcagggtgcaaatacaccacattattattctaaataatgggatttttaataacaaagaccaagaagattgtctgtgcctatctagttcccatctgtaagataaaaaggtgcagtccctgagcctcctaaaaacagcaccctaatggcactgctcctcccaggtatgattgcagtagacctacgtcagttcttgcagttcaaacacattttttcactttcttctgaaatgccctcaaattctatgacatagtatccatgaagacttccctttttacccagtgaagttactagagggggttcaaaccttcttacagagggttcctaaaatgggagatctgtggagtcattgggattaaaaattaaatttcaaattcatgacatcaatgtcctcatcccagttaaataaaagtaaatacaaccttgaagaaatttgacctactcagctgcaatagctgttgacctgcagaaggcaaatgatggaccccggccacgcaagaacacacatggcgtgggctgcgttcttgtgccccagctccatggacgtgtcttcttagctgtggacccctccaaaggaaactgcttgagtggagtgctctgtattgtcactcctgggaatgctctcttaacacccccatgccttgtgctatgtgttcataccagcataggcactcagaagcaaaaaaggtttccagtgaaatttgtttgcaggcaggtattaagacatcagacactgcaggatccaagtgaacccctgcccgcctgcctgcctgccctgctctgctctgcagaagggcatgtgtctgtagcaatctgccctttctgtctgcgatgggcagagaccctggctctgcctcctgttttccctgtagccctccagacctggggagagacatgggactccagcacctgcccagcacggaagggggtctttcccaggtgtaagtgtagggctgcattcactaatttagggtcataccacaaacactgttgtgtcaccaggatgttgtcacatgcttattgtgagcatttttgtgacatgagctttctcctgagaggccaccctgtccaaatgagagctgtagttggaggcacatccgtctcatgctgcctgggtctccctgcaccagctcactctacttttcctttttatccacttggagttaaatgcacacatttatgcacaagtgcacagaaggcccagaactgttcctaatagataattaaatgatctctctccagtggaaactctcctgggctacctggctgctagctgttttagcctcttcatccagtattgatttacatgcatcggtttgtaactcagacagtatagttagttagtttgtttcaccatcaccttccaacctgcttacgtttaaactccttctctctgcttagctaatacagatttctgtaaggatttggagaaataccagatacctcctggttagtatcaggacctctccattggcctataattgaacatcactgtaaattagtttcagcttttatagtaatgcatctaacccgccagcttaaaaaaaaagtgatgataatcatgaaattcaagtgtcaatatagacttttaaatctggtgtggatgttaatagtgccagatatgcttctgtgtaatcatttttgagaagtgctgtcttctttaccataatcacattaatcaatcgggaaatggttaaatagacattttaatacattgttttttcctgagaaaaaaagtgactccaggaaatatgttgttacaatatctcaacaccaggaattgtggtcacatagcattcttcttctaaataaagcatttgttttacaaaagagtttcatgtttacttaaacgtgacaaatgtatcactcttcgaagtgagagttaaatgaaatgttccctgatttagattccaagacctgtgactactcagtaggacaatagcatatttcttttactcagatacctgtttatccctttgtcagctccagaatggagacacaggtgctgccacacagaggagagggtcaggtgttttcttagtcacaaatgcagcagtctcacccctgaaagaattccttcataacaactaaattgcacctcttagaatacctgtacttaaaatataatttgtcttctatggatatagacaaataatagcttaaatgttttaggatttgtaaagaaagaaaaagctagaaatctcaatgcaactctgacttgtatgtcctgccataggaaggtttgggacttttctttggaagatgggaggcttccttcacagtttcttaacttctcattttattcaatctttctccatctctctctctctttctctcatcctcacgctctctgtctgtctctctcctgatttgtctgcttagggacagacaggtaatggagaagaaattgaaagggaaaatacagggaaaatgtaaatgaaaagaagttattataactgttataatgaagtgcctttcatttaaatataagaatgtaacgctgaaatgaacttgtgatcctgaaatgcatttttaatgagtttcctttttattttgctgcttcagtggcatattttaaagaccctttgaaaaaagccacattaaaaaaccccaccaaatgccacaacacgcaaaattggatattggtttattccaaaactgctgatcaggaagagtggctcttcatcacaaaatgttgcagtcactttatttaaatgagtttgaatttgcattgtgatgtgccattctgatttagggaaaaaaaattagattttcagatcaaattgacccagccagtgaagcgttaaggagctggcaggtttagtctgaaagcctcatgttctatcaaacctgcagccggtggaagtcaccaggcccccgtgggaaacaactttctcgtagcatcgtcctcatgtccccacgctgagtttagttctcaccagctctcctctctccgtcccaggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccggtaggtcccctggatgcagtccggggctgtctgggtgtcccgggattcctccactctgcccgcctgggtcccggattgtgtccttgctggctaaccctgagtccctcccagctcgcagtcctgcatcgggtgtgagctgttgcttctttgacattgccccatcccccctccccatattctccttttcccactgcaccagggagattgggcgcaggacccccatgcacatacacacacagaagtctcaccttaggtagcatgtttcagaacaggcctcctcatcccgtttgtcaggctggtatggtttccctaaaggattttgcgggaaatgttttcaccaagtgtactgctaagacccaaaacgttttcaagtacaattctttctgttgttaagtcccgctttggagtgttttacacaggtgtaatggatagcttttttgcagagctggtagagaagggtgatttagggcgcacccacccagactgagccccgtgtggctctcacaccaaaaaccagccaaggccacagttacagaggccagtctggggctgttaccagattttagacagcagcctttctctttgaattagacagttaaagtacaacccacataatctggagtcttgacaagatcatcataggcataaacgctctatcattctcaaaacagtctcagcctgcaaagttcaaatccactaaagtttggttagatcctctgcctcctgagaaatggtcctgggtgtttcattatccagcagtcccataattctacagggcagaggaagagagggctcttggccggcctgtcatggatcatgtttgcctacagtgtggtctatacaacatgacatggcacaggtctccttcataccgtccagttggggatatttgctgtagcatactgcatgagacttcggaggcgaaaggttgatggcttttgtccttcccctcaaggagcttcctgccccagccagccaccagccagggcccttctccaagcagcagcctctctaagccggtgccctgggggatggcaatgcctcagaccagctactcctcacccaccctgggtagcaggataaggaggagcctccctcagggaggcagacgtgtgttctttgtgaaatatctgcagcggcccaggccatctcttcccaaatgtgatgcgtgtatttgatggttgagggttttagaggctgctcattgtgtccatctctttatcacacatttactgagcacccctgggtgcccattctgcacagaagacctcaggtgcacacaaggaaagcaccaatgtgttacaggaggcatgacagagtgtctgaggggacagtgggagcataaggaaggggacagtgggtcctggggtggaaagtcaggagagacttcccatagaagggaggggcttctgaagtacatgctggaaggcgagtgtctgaggtttgctttagagacattctaaactagtgtgtgagtcggcagtaatcccagagaggggtgcggcacccatgttggcaagaactcggtctcactcctggcaggtggtccctgcagtagttcacccagttggctggagacaaaaaggagaggagtcacaggggctggtgcatcacctcctctccatcctgacctccttcctggcggtgcacatggagaaggatccccacatgctcgccatcagaaaattgtcatgatttgggtgatttgacttcctaaaaacttccaagaaaggagctataccaagctgaggagttgcttgcccgagagggcgggcagatcagcaggggggccatggagtgggacacttgccttgttacagagggacagggagaacaggtggttcccctgagataggaagacagtagcatgacggtgagcatctttaaatgttcacatgggtgatgagcatgtatggtggtcccacctggagacaaaggtggtacctgggcctgataagcaaggcccatggaggcctcagctaagagaactgtgcagtctgtctgccatgctaaccagtggtctaggaagaagcttcacatctgttgtttctaaggagccatgtagacatagacacagttggcagcaatattgccttgggttagtgggaagcaccacttcccatgtcagtggaaaacacagacactcgttcttaggttgacaccaaccataggtcatcatcactcctagattactctgattgcaatggaatctctcatgcccatcagtccttaaaagcagagctgctctctttcctttcttgttgtggagttaggaacatgtagtggagtattttatgttattctggctccaggcctatgtatttcatttgaggcatgatggtttcctattctaagtaccactaagtattgagtagttataaaatggtggtagactttggactgtgtatttctattctggatccacggatgagcaagtggagaaaacccatcatggatgcagggctgctggggatctgtctgtccgaaaatgctatagagacacacactgctcttggggaaaaaaacagtgatgatttcttcaaaatgatttcactgaagtgaaataaggactttggccttgctctggcaaattcaaatgtggccacactctactccattgtggaatggtgactcccctgtcccatgaaaaaccaggatcaacatcacagctttctctagcaactggtggtggcctgaggtcttatgaactagcatgttagcagggatagagttagggaatttgtccgatgctgacagcaagagggtgctgggggagctggaggggtggagaagtgatctcccttcctgcctcatggcttcctttggaagttgcaagcttagaatttctttcccaaagaatattggactatgcttcaagagacacttgagttcagttgcttacagtgaacatacttcttatgttccagagttaaactcaatcatattttcagaaaaatagatattcagacatcatgtcatatttacaggaagctatttgatcatggaatttactgaagtgacagctttttcaggaaagggtatcgagtggttatctatatcctattaatttctaaaagcaatgctcaataaaatgtgcaattttaggcaatattctgtgtttcaacattatttccttatgttgggggtacatcactttatatagataaagaaagatccttttcattctctattaaatggtcgagaagtcaaattttggctttcatgttggtcttcttactgtagcttctgttcacctaagaaagagatttaaccaacataagctttggctaaaccattgtaccaaacatttctatttggatgctcttaacttttatacaatactttgaaatgtgttcaataaaacaacatgagaaagaagtagaagattctgctattaggttggaaattgatattccttacataagtgattaaagatactttattcagtttatcccttaaaatggtatctactgaagtccttaaacttaggcatgatattaattcctggctagtctttctttttcctaaaatatcactcaataaaatccaagaaggactaaaactcattatatagaactgcactgcccaatacagcagccactagccacatgcagtatttttaattataataagttaaaattaaacaaaattaaaacttcagccctcagtggcactagccacactttttgtgtccaacagctacatatggctggtggctgccatattggacagcactaatagagagcatttctatcatcataggaagttctgttgaacaaggctgatctggaagctacaccatcctaaagctctttggcaagaaagcagagcttttccataagctcagtttatgaacaatatattttgtattttctatgtatatgtatatgagaatacgtatacatagaaatatatgaaaatacatatacatataaatatacatatacataaaatagaaatacatatacatagaaaatacaaaatattttgtattacatatacatatgcatggaaatacaaaatattttgtattatataatgcaaatgtaagatatatttatattatgtaagaaaatacatttgtgcaataaaacgcttatttcattcaagcatatttgtccagcatggtttcttagagactgaagttacccagtttagcacctggaactgaattcactctggctgtgttagatgtagcaccagcgtcatgacagatccagcccacagcatagactgaggcctactctggaggcaaatctgcagacaatgtggccaacacatgggccttcctcacatctctgtccagtcgctggcatccacgttataacacagcagtggctcgttttctccagttaaaggctaggcttccgtgattgaagcaggagagaatttggtagtcagtaaagtagacaaactaagacaaaacaagagtcgcatgagttcttggtacaattaaagaaacccttggccaccaacgtttttaaattcaggaatttcaccaagtccgtaacagttttagctctcaagggtagaattttttttttaacttttttggtaataattgtattgcatgcattccccttacacagaaggctggcatttaattggggtcttgaactcaattgtgttttctgcagttggtaaacctcacaaatgtggatattgtggccgaagctataaacagcgaagctctttagaggaacataaagagcgctgccacaactacttggaaagcatgggccttccgggcacactgtacccaggtaagcgctgctgctcggaggccagcctggtgggctctccccccagcacggtggggaaggagggcgctctgcatgcagccttaggagcagagccttgggcctgcttcctgccggggctaggagggagggaagtttttggccaatagcatcagtttcaccagaagcacgttgtgcttcccagctttctaggtcctcatctgaccagagagagcttgattttaaaacccttcccacttccaatcgggagaaactcctaggatagcagtgaccttgaaagttttggggttgttttttggatgttggtgattttaaaacaacaacaaaaaaaacacctcaagtagtgatatttctttgtaaacaaaataaaatgtaaaatattgttttgaaacaattttttaacaaagttgatcaaataagaactttcaggctgtgattttaagcatcagttcagactgagggcagggtatccactcctgcatggagtgtgaggttgaagtttgttggaagcccctggtagttgataatattgaggttgttgaaggatgagaggaaaggtcgcttctttcttaggagctgtgatgctccactgtattgcataacgagatagcacttgattcagaccccagagcctgtagaataaatgatgtggagagagtattgaaaaaggctggatttatctgggggaatggcaatgttataaaaggttcttccctaattttttaagagataagcaatttataaagagatcaaataaaactaatctctttcaaaacagtattcatttagcactacccctggaaaaatcatcactagactgtgagtcgaaatttaacgaatggaggaaaatttattaagcctcattcacctttcggactttaacaaatggttcaaaagggaaaattcaccagagtaccctcagattattaatggcagatgagagcaggaaaaaagaatgttgagaatggctaaaaattgattccaattagtcttggcatggagaggcaacatctcacctggccagagccctgcagccagagtgctgtctcctctgccagtcagccagggatctggggcttacaggcgattcctccaggcctcaatcttctcacctgtgaaatgggaagataccattaaattgtcatttggcttctttcaaaatctcaggtctagaatggaaaggcattgaaggtgagtggaagagaagaaactggatgttaaaataataataatgtaacagttattaattcacatggccagaccccagggcagaagactaatggacgagaggatgattatgttcctttgaaataaaatgtcaacattcaaatattgtttttttctgtaaaaaataagtgaatgggtcttggaaggaagtgctcctaatgatgtagtttacatattaatgcttaataaaccattttatttactcaacaaatattcactgaggacttataatcaataataccaagccctattgaatacagtaatctaatatacacatagaattgaaaagacaaaatgaacaaaagaaacagacagtatatcatttctgtttcctccactgttttcattactaaagaaacaagctgcagtacacagccggctgagagctgcttccgggggagcaggagaagcagcactcatttcactgagacctgggtttgagttctctgtttttgaatgtgacccagagctcatcgcttaaatgcgactgataattcgtgcctggccaccctcatagcagcgctctgaaagaaacataaaggagtggatacacgtgtgagcaggagcctagacatgtgtcaggtacttacctaaacatggatgtttaggtcactgacatactgacaccatcaagctaattcttctctattggtctctatgtcagtaaggctacgtgccagtaatgtgtattaaatattaccctgtggtgagtatcaatttcaccctaaaatgttcatttattccctttggtggttaagttacttggactaccacagtgatgcctctatgtccccacactcaggaggtatgaaagcgtctctaggaaggagcagtggtctggtctcagtgtggcagcagacaaagccaggctcgcacttaattacattgaattatttctgtctggtatggcctcaaaaggtgcaaaatgatcataaatatctttcgacagtcacctttggtttttgcccttgccagcacctggcccttgtaggtgctgctggtttaaggaacttggagtattaaggggatccataaaaggactttgacagaagtcttcctgaactgtgcttagggccaggaaggcaggcaggggcttggtcatttcagctgtgctgtacccggatgagtggaaactgtgccttctgatgcatctctcctcctctgttcccctctaagaaccccttgtctgtgctcagatggatgagcaagtagtctcttctcccaccccaaaaacctccttagatggggtggattcagtaaaatcaaagcctcagttaggcaatataggaaaagatgaatttttgtgaatataattttctttagtaaaaggcttttggtcacctcttataatttctcaatgtctttatggaaaaaataagtttctcttgagcctttggtgcacaaacagagtcaccagcccttggaggtgcatgcatctaatgacagagcagcctgtgactcgcgagcatcaggctcacttgttccttgctgtgattgactctggggggtggaggcttttgggaggccctgcgccatggtgcagaggaagacccctgacctctgggagccctgggcaggctgtgggtgtggcttggcagagaaggatggacatgtcaggaagcatattagcttaatagatgaagtgtgtgaccagtgtaattgggttttatggatttatatttatcttgcatataaatcagggtgtggcctatatatgtttgcccatttaataaaaaacacatattccaaatgttaaaatataaaatataccagcaacaatagccaatttgaaatatatgttttcaaagtaacattcataatagcaatgaagacataaatacttagaaatgaagaaaaccagcaagccatagtgaggcaagaaagaaaacatgggagattggagaggtagagaggtctggatgccgtccatgggcctctgcccaaattagtgtatcatttcaacataaaactggcttgtaaattttactggaatctggtaaccatgtatcataaagtatctggatatatacatgagataattggcaactttttagaagaagaataatgtcaagtgatgtatgaaaatgtagctgaaatggatggaactctttgaagaatagacaaacaaatcaataatagagatggataccctactgaagaccccatgataaatcagcatgaaatatccgaggcaggaggaagcataaggcaggaacggtattggaagaattgatcaggcatttaagataatcagtttacattatcatctccttatacactaggataaattgccgggaaatgaaagagttatatttttataactccaaccacaataactgatgtaaatatagatccagctatgcaggatacaaagttgtatcttcaattatggaaagagatgacatagaacaattgagaatgactagaaatggcccacacatcagcatttacctccataatttctaaattttctacagcagtcaggggtgctttgattttcaggagtttgttgtatgctcagggataaggggctctgggtttttcctccacattgcccagatctgctgtaggctcttgggggccacatttttgtatctccgttcactgtgctggtccatgaagtcagatgttagatcacacagttctttgcgtctcagagggctgctgttagggactgactgaggtagcagatttgggagtattatgaaaagttaaaaggacttgtcaaagggacatcaatacttaatcccagtccagcctctggtgatggtggtggtgcctgtgcatttggacttaaagaggatgatgtgtggtgagcagctgttggaggaagaagcatttgcaggtggctggtcattggcattgctccggctgcctctgcctgtctggaagtgttgctgggaagattagaattaatctctaggaagggcctggctcttgtaggcacttaacaaatgtcagatttaacattggacgcgactgaaccctttaaacataagcctttctaaactggcctctctgtctttgactttagtcattaaagaagaaactaatcacagtgaaatggcagaagacctgtgcaagataggatcagagagatctctcgtgctggacagactagcaagtaacgtcgccaaacgtaagagctctatgcctcagaaatttcttggtaagagttaaatgtttgctgtctcttaaaaaaaaactatgtgggtgttttagatgcaagtagaaatgagttgagggtggaagaaagggaaaaaaatcttattttttcaaaaggaaaaattggtaagcttaacattccttaaatatcttagaattttttccaataagtatcttaaaaataacaaacctcccatcagtttttcctagatttgattttgcagcatctggggcctgccctgtgatctgcctgtggacatcgctcttaggggcggctgcaccagcgtgcacagggtggagagtttgggcctggctcgtccgggggacaccacactgcaggacactccaggcctggccggcttctcagagcttcagatcctcatttttcatatgaagctcctaatgctccccttatgggggactctgaagggttaatgggaggaatcatacagtgactgacccctgagaagtgtccagtgaagacagggcttagctaggattgctgttttgcctaatgctctgcgggattaaaaaaaaagaagaagaagaacaagaccattcgtctctctaggagcattgcccagagtaggtattagacacaccaacaccaccatccagccagacgctgcagggacagtgagccagggtccgagtggaaaggcgctaggcttgggaaccagctcagagtcaatacagagccaccgccactcaccaactctgtcagcttagtaaaatggctctgcccctagagccctggttccatcctttagtatctcacagggtgattgtgaatatcccatgactccaagattgagaaaacgtttagaatccctcggtgtgaaggttaactctgtccggaaagaggaccagtaaaagcttcatgaggctgagatgcactttggaagaggaatagagtttcagcacattctaggtgttggaggaatgggggaatctaggcagatgtttaaaatcaatgagaaaccagaatgctgaccatgagggttggagtgggggcctaaggacatgacggaggagcagggtgtgttcccagcttaactcaggtacccatggggaagcaggaaaagtgaaggtgtcctaggcagctctgccacaggatgaatggcttcagatgccaggtgagcgagggacccttcattcagtcagcaggaaagaagcactggcatattttttatgagaacaaaggctaggatagtaaagacagcaagtaccaaaaaatgactggaaaagggagactgtggaggcagtggcagcaggcatggaaagaagggcttgtgaaggggaaggggtggtgtcagaggaacatagggctgggggcagggattaggtgagggaaaccatgagtcacactgattctagagtagtgtgcccttgatgaaaaggataacaccaggttctaggaaaagatggggttctgtttttgacgtgttgattttcaaggacttctggtgtttgtgacacatggggaaattgtggtgggagagaggtggggccagaacaggggctggtgaggccaagggtcccagagggcacctgttgacctgcaggatgacatgaagggggaaggacagaggcaaggccaagtcctgggcaccagcctccctcttgcagcttcaaatagggctccattttgaccttttgattaattagaggtttgtcataggttgggggttgagaggagcaagggagagaaggattcagtgtacaaaaagaatgaaagccactggctgagccagtggggagttgtccacacacacatgagcctttggaccatgagaacgagggaggccttgccttcctgaacggagtaggagtgaggtcctgtgctgagcgtaagcagtgggattcccacagcactgggcacagagcccacgggctgcctcctgagcagccagcatctgcctggggtggacacagtgacagagagatgggtggtgactggggtatgggcagagataaggcagcaagtgtgtgcaaggggagtgaagggttactgaccttaagaagcagggatggcgtcctctgtcaggtgaggagcctggagaatgctttggtgaatgaacgtttgcagccccttttagcttttggagacttgaaaccaaaggagagattcatctgtgaaactctactggagccactccccaacccccacccttgtgagaccacaatgtgggcgttggcttgagatgcttctgtgttagtagaagaaataaacaacacagtgctctgatgaggcaaagcgaagatgaaaaaggagttcccaggggacatagtaggaacagtggacgagggtagcagaagaggagtttggagcaaaagactcacaagcagctgcataatctgttggtgcttggcagttcatttgtaaaaatgatgcctcttcctgccctaaaatacctaccttacccccgcttcaacttgatgagatttccatcagtcactcccaatgtgtcacagcttctgcagccctaaaattaaaaggtgagtgagtctctgaggcccctctccacttctcggatgctgagtttagccttcatgtgaatgtggaaagactaggaatacagctgttatcacacaagctggcccaatagtggttcagttgagagagccccatccttcagagtcagctccagctaggagtgactggtggccttgagcatggtgctgggcttagtgttgccatctgtggaatgggtgtgggtctgttgccctgcctcctcccagagctattctgaggctcagaaggggtgatggatgtgatggtgctcccaacactagaaagcatcttaagaatgtaagattttcatgatgactgttgctcagagtggctattatagttttgctttattgttctataacctatgattaaaatttttaccttaaactttgacgtgagtgtgaataagtatttgttttgccagcaacattcctcaccactggggccattaaagatctccccctctgagaccatcaaatacaggtcaacaggactgattaatctaattagaaaagggcttgtattaaatagcaatgataattgttgtttttagtctgtctggtgtttgacttgggaacgtttttaaaatagagaaaagcacaaagaggaaaacaacaattaccaatattcctgctacccattataattatctaggtatattttcttcttttgtaagaaaaagaaaccctgttatattgttaaaataacacaaagttaatataaagaattttaatgcaaagattaatgttttcaaatcaccacaaaacccaacatccagaaattaccaatattaaaagtagaaaagtatcattctaaatattttctgttgcatatgtatgtgagtggataggctgatgaattaggtggattgatggataggtaaatatgaaataaatactttcataaatattccaacttatcatacatgccttaaattcaagaggtgaaaaaagacccaaacaaaactagagaagcggcttattttaaatatcctctgacataaaggaatattatatttaaaggatcctctaagattaaaaatatgtactatgaaaaacattaagaaatttgaattttttttaatccatttgtttcaatttaagcagcatctactggctcactgctttgaaaaataaggacagtattccagttcacattcagtgttccagtgttcacattatcttattatttttacattgtccagctttgtaatattcacattctattctgtaatcataattcatagtagtttagttatttattactaactctatttaaatagattcaaggatcagaccctgcccttttcttcttatttatgtttattttgattaatctcttaattgattggactttacattcaagcaacttttttaaaaaaaagtttctatagatgttctatttctatcattgtattgtttttgaggatgttggcctgttgcctttgtatttgatgagcattttgacagagtctatggtcttgggccactctttctttttctcccttgagaactttttagattttgctgatggcattgcttgttgaatgttgctgtggaaacatcaagtctagtgtaactgtttcttcttcaaggtgatttgcattttattcctgaatgcctgagggttctttatttaaccttgaagttaaataccctaattaggatgtatcttggtctattcattcggaataaaaaattcctgccattttgtctagagagtcccttttttttctctttatttctgggaaattctcttttatataaatatgttttgttccatctattgtgatctctgttgagggataccagttgtccatatgttagataatttgtcttccatatctgttaacagttcttaaagttttttgtttatttctttgtctatttttacatttactcactgttctcttgtggttttcctctgtcagtaatttaatttttagtagttcctgttctattacttgctatttttaatccatgcattaattttataataatattattttgctccttattttgtctcctgagacccgaaatctcttttttcctcttactctgttgcttttgcattttattttgaatacttttaaaattgattccatgttatgaagcaattatgaggcatttcctctcttgttggaattaacgattttttcccctaggagggactctatggtctgtgttttacttcctttcttcccctgtatttctagaaaatattttcctagtaaccctgacatttcttttcatcttgcttattctagttggtctgatatagcttgattgacatttcagccttcttcccactatatttttttttcctgtgagagctattgggttttctaaatcctgaaagaatgccaaagatggggttggaggagtttggtgaggcaaagtgcagcctttgttaaaatacttttcctttgctctctctccctcatctgaaatttagttaaataccctaagccatcagcactgtacctagttggggaatgctttcatccccacaggagattctctggggctttgggccatcttccccttcagtgtagaccacagaggactttgcttctgtcccagggagcccgcaggggctcacttctccatgttcatctgattcttgtcagccaaggtttcaaatgcttttctgatcagaacagggaaaagatacctatctgaatcatgtctttatagatatgaggctatgagggaaaattctgaggttattcttgactcacacctaaagatttggaaatgagattagcagcaaagctttgccctacatctcatgtcagaattttctgtttctttctagtctttgagtgtatgtgtgttctcacacacgccataatgaaatgcatattatatataattatgtgtatatataatattctatgactatacatgacatgttcctttagctgattgctgttaagagaaatttataggtttttatttttcttgttttgttgggtattaaggaagagaaattctatggtaattttcatgtggcacagtaatctggcatatatgttgatttttttcctacacccatttgttgtgataccaagtttgaaaacaacagatttcagtggttgcttgggaaaccacagaaccatgacttggggagagacaggatgattaggtgggaaagcacccttttggtggggctgtaaagacttttatatttagcaaaattggctacaaagtccattcccctccttttcttgccttgatttggtagagggatagacttggatacaaactagaatggattcattcttctctggagttagtgtaacaagacatttagctgctcaacacaaaaacagaaacaaaaaaattgtgtggtttcagcagtgctatacaattactttttctgacctttaatggagagaaacaccacttctttggtccctaccatcagcttcatagggttttcatcctgttctgtttctgggagggcgtaactggccatgcacaagttttttttctctaatcagagtatgtgccacttctgaccaccagtagatgaaaacgaatggaaaccaggctattatatgatacatatccattacaaaataagacatgaaactcaaaggtactttatggtataatggggcatatattcctggacaattcttaatggtcacagattttataaaaggactattagtaaatgtatgaattacagagtaatttatccttctgttagtaagaaccagctgatgacctcagtgtcaggtgcatcgtggaaggtgttgggaccttcccttgccaccaccctcaccagccatcatcagccataacctgcacattggggaagttttgacttatccctcacttttgcccctcttcaagctgttctttccacagtgaatgagaaggccacttcttccttcaaacctttcagtggtttccattttcctttagacaaagtctctgcctagctggcctctgcctgcccctcctgcctacctctcgagcactgcccccacctagggctctggttccccaaccttcactcggtcctgccacacctcccagccccttctcccttcagaactttccttcttgttgtccccaacactgggacacaaaaccctccttatcaaccctccttatctggctgactcttacaagatcagaaacctgtgtaatgctctcatggcacgctccccttgtcttcgtggatttctcagatgggaaggaattatccatgcaatcacacataaacttctacctaccctcccctagtagctgtctgctgctaaggatggggaccattctcacttactcactgttctgtccctctgcccagtccagatgtgttgaaggatggaaatatacagagtagtggtaaaatataaaccgttcagacattccaaggatgggctcatgtgctttgactcattaatgtaccactgctgaaaacagaacacagccgcagtcttgccagtaagagtgcagttactgtaattaatgaatttgctaattaagccatgatttcatactgaacttatgaccaacatattgagaaggtgtgtcttcaagaaaatttattttttgtattaagatatttactccaaagctaattgaagaagccaaatctaggctctggtttcaccattgccagggaaatgagctcatggactcctatgaactgatgatgttagatcagaagtttctcaaggccagggcccaatcactgctgaggcgtcaacagtagttccttgtacatcaataattctcattacttttaaaaaataacagatgaatagcaactattttccctgtagctcccttgctgtgcctcctaccctccaccacatgtttctggggagccctgcttcgggcctgccaactacagagaattacttttgagtatcccttccactctcatctcaagacagagttcatctacctttgggttatttgtcaaaaatgtgtcattttattacaaaaaatatacaatcatcatgtattttgattaaattttacactagattattaaaattattaaatacaattattaaaattaataatttaacatatcacatattttaaatatattgtatataatgaataataatataattattgtctattttaattcaataaatgtatagtaagttagccagttgtaaattactgagaacactctactgaaaaagcatcatttcaaatacactatttaaaatattaaatgaaatacaataacataattaaactaatctttggttcccctatttatgtattcatttatccaacaaaatctccttaagtgcttataatgggtaggtcctggctcggtgtcccctagacagacgcatgggccttcccccagcccgtcagtatggtgcaggtgtgatgtgtccgcaggtgtgtgtgtatgtgtgcaggtgtggggtccgcaggcgtgctgggcccccaggccgtgttccccttcccctccccggttgtagatttcagctgttgctgccagacctgaccggttccggaggtggccgcgccccactcactgtcgcctgctttccacaggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaa

SEQ ID NO: 1779 - DNA, 125369 bp, Homo sapiens; identical to SEQ ID NO: 1778
  source 1..125369: mol_type = genomic DNA

SEQ ID NO: 1780 - DNA, 125369 bp, Homo sapiens; identical to SEQ ID NO: 1778
  source 1..125369: mol_type = genomic DNA

SEQ ID NO: 1781 - DNA, 125369 bp, Homo sapiens; identical to SEQ ID NO: 1778
  source 1..125369: mol_type = genomic DNA

SEQ ID NO: 1782 - DNA, 125369 bp, Homo sapiens; identical to SEQ ID NO: 1778
  source 1..125369: mol_type = genomic DNA

SEQ ID NO: 1783 - DNA, 125369 bp, Homo sapiens; identical to SEQ ID NO: 1778
  source 1..125369: mol_type = genomic DNA

SEQ ID NO: 1784 - DNA, 4892 bp, Homo sapiens
  source 1..4892: mol_type = genomic DNA
gatgtgaataagatacatttatttattcaaaattaaaatctgctatgaagacagacaaacaatgtaacattcccagaggaattgaataaattctagttaaaactgagttctattagaaccaaatttatttttatttttattttttgagacagagtcttgctctgtcacccaggctggagtacaggggcatgatatcagctcactgcaacttccatctcctgggttcaagcaattctcttgcctcagcctcccaagtagctgggattacaggtgcgcgccaccatgcccggctaatttttgtatttttagtagagacggggtttcaccatgttgaccaggctggttaggaactcctgacctcaagtgatccacccgcctcagcctcccaaagtgctgggattacaggcgtgagccaccgcgcccggcctagaaccaaatttaggttgttataaataacaagctggccacagctttcaagaatgaagtggttggggaatgaggttaggggaatccctccgagacactggaaggtgaattaatcatcaaaggggctccctggtttctcttcctaagagtatttgtagcagttaggaagccccaagcccagagacaagataaattagagggaggtcagggaaaacagctcaacagctagaaagcgtggtcaggcttggaatggaagcttctgttggctccccaaagaacattttttttcctcccttatgtaacttataatttatcttaaaacactcaaataccatagtgtgtcaccctatggaaacagcttaaaaacaggtgaaaataataaatattgaaaaaaattataatattgggcttctttctaaatcgttcacagagaagctcagtaaataaatagaaatgggggttgaggtatcagaggtaataaatattctataagagaggtacaataaggtttctcaaggggctgggtcagctatcccagagccccagatccgattttggagacctctaatttatgtcctagagtctatagagtcgccaccctgatgtctcagtttcgtatcttcattgtcatgtaggcttctatgtagttgatgaagatgtcaaactcactcatggctttgtagatgcctttctcttggagctgtgcagagagataagaaacatacagttaaaatcctttctggggactaaataggctcccctccctcatgctcatggatgggcatgaccttgagtgcagaggttgcttgttctccctcacgctgggaagtaaaccagaggataggcctagctgccttgggaaaggctgtgcattgaccttcatctcctccaggcctccccctagcaaggggagcattcattttgcaaagcactgtcttcaaaatgatgccttttcaacaattttaaaggtcacgtattcacatgatgattatgcagagtttgatgaaaagacattagaggaagcgcttcgaaagcaagacggtgagaggagaggagggagccttttaaatgtctgtgttctcccaccaacacactgagcaggccctgccctgccgccctgacctactatgagaaattcacaccccctgatgttggcactctgtgcagtgtctgtccccagcccacgaggaggacataggccgcacggtttctgggaaatcagactgaaaaagttcacgcacagttggaagtgtgaaaccccatttcgtttgggaactgacattctcaggcacctccgcaggtgcgaagggcagatggaaagcgggcttgaaccaactccaggttaagtgagaatccagcttcctgctcattctgagttctggggagtctgggctgaacccccaggtgtatttgtatgtgcacatttatgtgccagcttcctgcacgtgtgggttcagcctagattcccaacaagctactttctgtactttctgtttcctttgtcactctccccagcatgcagctcactgtgttcacaggctggccggccagcctaacccgcaagcctgcaaaggcagcgagcagtcatttagaaacccccaaagacacttaacagaaaacaaatacaatcaaggcagcagctcctcactggctgagcaggtcataccatctgtcaggttcccacactctctccaatgaagaatggggcctattgagtccccaccaccttccatgctttggggttggggagtgggcatgggttgtgctctgcagaccctctctgccaccatccaagctcaccttattaaaggcattcttcacctgctccacggccttgctcttgttttcacagggaagaaatcgatgctgtggaagaaaagagaaagtgttggtgatcctggcttccagctccatgtccatcacacttaggggacaagctggtggcatcatgaggaggccagatttatccaaatgccttgcctcacagctcccagagagaactgagccctgcttccatggccctgggagttaaatgtatttctccaggactcactccaagatgtttgcaaggcttggatgacaacccaggtcttgggattccttcctcccccagaactctacagtatctcctgcagtgctgagcgaggcattcttcagcctgtccttttctgcctctctctcctgttcctccccgtcagtcacagccaccgaggaacacttctaagcatctgaggagggaagctactgggaccaaacccttcacatagccttgtcctacaaatagacaccaactgattttccaatattggtgacagaacaggggaaaccattagtagtgagggcatcatttcagttggagaaataaattacctggaggaattactcatagacactagcctggggatgaatagcccccttgtcccttctaaaatgccaggggaaatcctgtcagtcaattgggcccttcttagagctttgctttcaaaacattgagattaaaagaggtgaatgatgtttcctctgcttgggaaccttagctccccgcccagggtctagttacaaagaggcagtggaggcctgactgaagctctgggctccttttatgaagagagaggggagtagttaataacccacaaatgactcacaaataacaggaaagctgtttgcaaatttcacatgtaaatgcctagcagccacccccaacgcctgctcaaagagaaatgagcaagagatctgactccaggagtctttcctcatttacagctagctctgccagtctgtgtctttgctgtgtctgtggatgtgagtgtccctgctggtctgtaggagatggtattttgggggcagctgcaagggaaaaaactgatctgctacttacacagcgccgtagcctcagcctgagggtcttcaggttctcccccagggagttcacatgcgccttgatgtctgggtcttggttctcagcttggggcatcacctcctccaggtaaaactggatcatctcagacaaggcttggcaacccaggtaaccctaagggcaggagccaaaggtgagtgagagattggcggaggtggctgggaggaggggctgctgcaactagcttaagaggacagcttggttctagcgatcctccttcaccagaagcctccccgaagggactgagccctttgtaaaccctctggctgctggatgtgctgagttaacatcttcccacttctccttttcaaagcgaaggaaacaaacccaattccctgcaatcaggaagcagagtctcccttcccttaatcatgctgcacactcccccagcaccccgcccctgctctcaccttaaagtcctccagcaaggactcctttaacaacaagttgtccagctgatccttcatttgctgcaggaagaacaaaaggagaatgaacttgaggtttggggaaataactgaaatgcggtctttttgatgccctttcatttagagatttttttttttaaataaaattggctctggcccaaaaaaatcaaaaggggagttttaaaaacagaggattcaacagtgatgggaccatcacttaaatcaggtcctcctcctcagagtcaagttatttaaaaaatctggccgattttgaagggaaagcagaagcttgactcagtcctggtcttctttctgcggagctacattcggctttaagggacacctatgtcaacccttcggggccttgagcccccctcatgtcctgttctctgcttttctttctccccactgtagacatccagtttagcttggaaagatcccagggattaagaagctccttctaatgcaggtttccctcatgtagagtgcttccctaaaccactggtctttcaggtctggaaacgctctaagcagaggcaatttaaatttccctgctgcaaggcatggggagcatcttcacctcgaatcagacatttctttacttctcctagccaataaagtatagagcgccagcaggatcttataagtttctcagcacgagagagaacgcatttactttataaggcaggtttcctgcacatttactgtatcatctggcttagcttaactcaccaaacccatggcttgatctaggattctcttaagaatttaagtttgggggaataggtgttggggatggaggtggaggcgcaggaggagggttcttatagttccaggagaatgtctagttcaggcagtcccaggaagagagaaaggacaggaaggaatcatactcacaaagaaagtcttcactctgctgaaggcatctcggagatctcgaagcatgttaggcaggttgcctgggaagtgggtgcagctgttctcagactgggtgccctggcctgggctggccctcaccccagtcaggaggaccaggcaacagagcagtgctgagctgtgcatgccttcttttgcaagtctgtcttgtggtttggttttgcaagagcaagcccctgatgtgt

SEQ ID NO: 1785 - DNA, 15093 bp, Homo sapiens
  source 1..15093: mol_type = genomic DNA
gtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatggtaaggctccgggacgcggcccttccctgccctgccctctccgcgcccgctccattaaagttctccatccagtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccgtaagtttagctctaggttttttgctgtttaggttcaaatgatgggacttcttgtccccttggggaataattttgatctcctgactctcccttctcttagtcgactcttcaactaacctctgtctgtccttctcccatctcaccttcatccctcactgatcaccccgatctgatcccccttgctccacctgtagcccccaactcactcccactgccccctgcctctctcctcctaacccagccagttcaggcttctaacccagttcaggctcctaacccagacagttctccggcaaggtttctgcaactaagaaaagtaaaccccagagacagaatgaaagagccgggagttggaaggaccaagagcagagacagagagcaaggaccgaaactgcttcttcatgacaccaaaatacaaagtaaaacatgcagtcagccattcacgtgatcgagagctgagtcggagatgtgcagcccaaataccacaacgactcgctgcatttttcactttccgtctaatgtttcgaaatcaaggcactgacgtgaagatcaaagacggtataagaaagaaagcaagagacagatgacagagtcctcccccccaaaaaataaataaaaaacaggtgcatgattagagagatgtagagaagttagaacactagggagcgggagcagagtcgctgtcaaatggagagaacttagaggatcaaggaggagagaaagggaaccaaccagccgttggccttgcacatacttcagtctgcttgatcaacaagactcttaaagtagaaatgtttgttgcattcttacaaagaagacaatgccttcagcagtgtttcccatggtgaatggtgtgtactgggggtaaagggagagtagagctaggaattggtattgagtatctctcctcggagctacaggtgccagctcttgtggggatgtcctcagccatgtgtagagccagagctgatttattccatctgtccttgcccagccagaggttggacatctggctataggcaaagccctcccagaaactagggaatgaggcaagcacttagcttggggagcccaggagacctatgaagagaaggaggcagatgtcagcaagcaggctgtctgtgtacttagtgaggtggctttgagctggagcctgggccaagccagggtggggatcaggtgtgtggatggggccaagcctaggaatagtgctagagcagggacagggattgggcagagccagggactaacacatctgagagctcattgccaacttgcttagccctcggcccctgccttcttccctggtaggcatcagactcagcttggctcttctcagcccccactgcagcttctgatcacagagagcacagggcagtgatttagggagacacactagctctagaatcagacacatgtggattcatgtgcccactctgccccttacgggctccgctggcctcgggcgagtcatagcctctctgaacctccctttcttctttggtaaaattggggtcatcaatgcctgccccccctcccagctgtggtactgacactcttctccccagggacagagctgcccagccctccgtctgtgtggtttgaagcagaatttttccaccacatcctccactggacacccatcccaaatcagtctgaaagtacctgctatgaagtggcgctcctgaggtgaggaaaagggaagagggagggggagggaggagtgaatccccgccttgtcctctactctcctagcatgggaagatacctgccttgttaatgaagtgagtgcctgagggcccctaacacatagccagcagttgacaagtactgactgagactcccttgctgagcaatgtgccgggagctctgggtgaaaaggccagagcctttgctcactccagagtaagaaaagccttgtgccaaggcttttctcttttttgttttgttttgttttgtttcgttgagacagcttctcgctctgtcacccaggctggagtgcagtggcgcaatctcagctcactgcagcctctgcctcctgggttcaagcaattctcccatctcagcctcccaagtagctgggattacaggggtccaccaccatgcctggctaatgtttgcatttttagtagagacgggttttcaccatgttggccaggctggtctcgaactcctgacttcaggtgatccacccgcctcagcctcccaaagggctgggattactggcgtgagccaccacctccggcctccaaggcttttctatcttactggaaaaggagaagcatccacagtacagccagacaacaggggaacactaatgactgtaaaggcagtggggagaagggagagaccaggctgtgctgtaggagccagaaagaatttctggaagagctgggcctactcgtattcctatctaaaaatctgctagaccacatggaaattggtacggggtcccaagaccaagggagacccctcacaatgagctgccgtggactagaggatatagcctgagggctgtcccagtttctcccaatgtgggagctctcttcctggcctcttgcgtctcccttaaaggaggtaggattgagcacaagctcgtttccagtgcctaacctggtatctcctcaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaaggtgcttttcctcccttgacttagaacatggctctgaagtcccttccagccaggaactctagtctagagcttttctgtctattaccatagctcaccatgtctgccagcctccctggccggagaactagttgcccaaacagggcaggactttggagaatgttagataaaaatagcccaagttgtttgagatttaaaagggaactggagttgtttatcctacagaagagaggtcttggggtgggttgggacagctgagtcaccaggtccaggcctgtgaacttgttttttcagggagggttcagggagaggaagcgaatccatgaacactcagcatagggcagcaagcagtaggcagaatttgggtgaacgccccgcttctttaggggtgaacacccaggggtcatccctttgaaatgggaagtgctactaaagagaagttatggatccctctctggagaggtaagaggaaaggataagcccccaactcagtgggatttttcatcccaccagttgggattgagaaagttttgtgtgcatggagacctcgctctgtaggattcagagttagagccgatggtctaggaggtcattggcttccaaatgcctgcccacaggccactgctcagctggtgcagaaacgtttcccagcaagtgtgtttaaaatatctatttccagggcccagcctcagaaattcagaccaactgtgtcttgaatgggcccagggcatctgtattttttttttttttaacattttgttcttctttgtattttgatttgagcaaggcaattataaaaagacatttttgaggaaatcaccatatttgtatatgaaatggtttttagggcatattactaggtatttgtttgttacatgtgataacagcatggtagttatatttacaaaggtgtgatatgtgagagatacatacttacgtaattaggaattaagtaatacagtgcttgggatttttctttaaaatgctaaagtaaatttcatggggggatattgatgaccctcccctgccaccaattacttcaaaattggcctagtgtttgcaattactaaagctgggactttggaaatcattatattctcttctacttttctgtctattggaaatttctacataaaaatataatcaatgcaatttatcacattaaccatttaaaaaagaaaacaacatttaaaaagaaactaagcaaagttaaagtagaaagaaaatgtcctaacctgtagaaaggtatctatctacacatatctaccataaatattatgcttaacagtaaagtgttgggctgggctcggtggctcacggctgtaatcccagcactttgggaggccaaggtgggtggatcacctgaggtcaggagtttgagaccagcctggctgacaaggtgaaaccccatctcttctaaaaatacaaaaattagccgggcgtggtggcgtgcacctgtagtctcagctactcagggaggctgaggcaggagaatcacttgaactcaggaggcagaggttgcagtgagccaagatcaagccattgcactccagtctgggtgacagagcgagactctgtctcaaaaaaacaaacaaataaacaaaaaacagtaaagtgttgaaaacgttttataaaaaagtttttcttttaattgacaagtaataattctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccacttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctccttagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacatgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttgtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcatctgattttagggtatatgtatttttaatgtgctccccaagaagtccttacattctgctgcattgacaaacctgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctgggaagatcttcagcatctataaaacaccgctttttcttttaaaatacaaaataaaattgtggtcattacagagatcatgtgctgcattggtaattgtggggtttgtcatcttagacaaaggatactgaagggggttggctgaaatcacctctaaaggcccaccagctctcagtgtccgtgtgccatgaaataaaaggattttgttaattgctatcatttttgtttcagttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtgtgagtcagctgggctgctctcagcatggggagggagactgggagggcctggtgcaatccaaaacgcgtgcacctgggatgctggtgccagccactgtgttaggtgctgcttcacatagctctgcatccttaataggagagaggtcctactgtcctcattttagagatgagggaactgaggctcagtattagcaacttcctagggttgcacagctaggacttggtggcagaaccaggtctcttggatctagggtcctcccactggagcacagcggtgtttcccaacaacatccccctcccccggggccatcttcagtgagctgtgctagttcctgttgttacagtcttctgctgttcttcctcagagccagggatacaaagggcttctccttacttcccctactctgctctgctcctcgccagagctgctaaagtcagcaaatactgctccaggctgtcagtcaggtgccggggctgtagggggagggagataatagaggacatggaggccacggtcttgcctaggaggatcttgcatcctggctggggagatagagtgtgcacagaggagactgtaacaagcaactcttattggacagcagatgagatgtccagtgcccaatgaaacatgccaacagtaagtgctctgggagggcccagtccagtgtgggcagagtctggcaaaggtgaaagtgactcctgctagatctgcaacaaatttcagtttgtgaaggacactcaacagctcagtgtcatttaagtctcaatgcagaggaaggcactaagtgggtatcaggcagtcttaagagtttttcatacattcattcactgatacatgaaatagttccaaatctcagctttacaacttttgaggtatatgactttgggcaaattacttaacttctatgtgcttcaggatcctaatatgtaaaaatggggctgatgatagtatttacctcctataagtataaaagttaaaagaatctgatggtattggtacatggtcagtgctgtgtacttcacaactaccttatgaggtcagtggctctgacagagtaattaatttgtccacaattgcacagctagtaagtggtgaagctgggacttgaacccagatctagcagcccccggagcctcgattcttacctgctgtaccatcctgcctcactgttctgtttgctgtgatgggagtcatgtgcagagagctggaagcagttagcgcatctcctgagggaatccttcagggcatggtttggaaggccaggtagggattcgcagaaacctagacacatctagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacgtcatcatcttctttgcctttgtcctgctgctctccggagccctcgcctactgcctggccctccagctgtatgtgcggcgccgaaagaagctacccagtgtcctggtgagtcttgcaaggaggtcactgccccgtccttcccagccacacccgagcttccaggagggcagggagctcttttcctcccagccagtccattgccttagcttgcctctgctctcagccctgatgtgattgggagataccttcatcaagcgctgtggggacagagggaggaagtgagcatgaagcccagtaccgagaatgttgccatccagtagctcagatgagacacatggaatcacaaatctcaatgaccacgagccattttgatatgatctactagtagttggccatggactagcccctgtgcattgcatctctgattatgaggcacagttattatccccatttcataagtgaggaaactgaggcacagagagattgttacacacagagggccacacagccaggaagagtcagggagggaacccactttcctactgctattagccatgggtgttccacaagagagaaagaaggaaaggccagaagtgctggtcctcgggctgctgccagagtgggccagaggagagaggacactggggggcggtggggatgctgcgccactggagaggggatgctggcaggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctctcaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttctttactgttgtgccactttgtgcaagtcatttaacttctctgagcttcagttttctcctctaggaaatagaggtaataatacttctcttacagaattattggagggtaaagttcaattcaacatatatttattgagcaccttctatgtaccacactttgttctaagcactgtagacacattacaacataaggaggcaggtactgtcattatttccatgttacagatgaggaactaaagcacagagagggtaagtaatttggtcagggtgacaaagctgataagagtcagagctgggatttgaacccaggaagtctggctctagaggacacatcctaaatcaccaagcaatgtgataggaatagggactcaaccaataagagctgcatttgaatcatcatgtaccaaggaaatgagggcagatgtgcaacagtgagtcagtgagtcagtcggcagaccttaggagggcctactgtgtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgagagcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggatacaatagaataagaactgcagaaatatcgtggcacagctcataatgatgagtattattttgtgaaactggtttcagttatttacatacgggttatatatacaagtcattatgcaacttatttctgattttgagtcatagtcaaaaaagtttgaaacatgcttctagatgggtctagcctgctttcaggtttgaaaagcactgtggatggagccacctgagagttttcaccatgctcagcagaccttggttctgcctgttactccatctgggcctgagaatacaagtttcttgtgtatctggcctgagccaaactgggaattgcattaggaggaaagctggattcgaaaacaaaacagaatacattccagtgtaatttagactgtagtctcctccatcgagctctcctcctgggcctggccttccccggcagcactgggatgggtgctggaaggtgactcctgcttctctcactctgccctctcttccccagctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaa

SEQ ID NO: 1786 - DNA, 15093 bp, Homo sapiens; identical to SEQ ID NO: 1785
  source 1..15093: mol_type = genomic DNA

SEQ ID NO: 1787 - DNA, 30875 bp, Homo sapiens
  source 1..30875: mol_type = genomic DNA
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttccggttcaggcccgagcaccctgaaatctggattctgtcccccagcgccccagctccatggcttctaaacctaaatccattgaaaccttttctgtcctctaaattgactgcctaggttccaataacaccatggtcacctccttcctttctcatgaactcttccctggccttccgggatacccctccggtttcccgccctgtcaggctgtctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttgtttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctggatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccaaagggaacctgactttcacagctcagtacctaaggtgggtctggcctcactattggcaggaacgcaccggaggagccagccctgggctggtcactgggttgggccacaggaggaagggagtctgactacggtcaccgtgtgactgtgacaaccctcagggagcctccctgccagccttttgctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatgagtagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcatacctgtagtcccagctactcagaaggctgaggcaggagaatcacttgaacccaggaggcagagattgcagcaagctgagattgcaccattgcactccagcctgggtgacagagtgagactccatctcaaaaaaaaaaaaaacctagtgaaaaagatgttattgcaaaacaacttttgaaatactgcacatgctggacaattgatgcattagtttaaaagaaggaaatgggccagtaatcccagtactttggggggccaaggtaggataatcatttgaggccaggagttcaagaccagcctgggcaacatagcagcctcttgtctctacaatttttttttttaattagctggacttgagttggaaagaaggaaggcggaagggaagaaagaaggtagggaggaaaaaaaatatggccacatgtgagaaaacccccttaatgaaatgaccgctggattttccaaatgatgggatgttaagcagccgtgaagaaatggttgattgacaaatatttgtggtatattaagtgaaaaaatagcatgatcccaatgatctctatctactttttgcaagggatttttctaggtatcactaagaatgctgtgagatgtgatgtgctaccttagactatgaagtcaaacagatctgagttcagttgggcagatttcttaggctctccacgcctgacccctgtgtacttaataaatgttggctgttgttatttttatcaccatcactttcatcatcacttctgggagcaaccaaattggttttggcaccagaagatgtcttgggggaccaatcagatagctcctcacttttttattttattttataaatttttaaattaaattaaattaaattttttgagacagtgtcactctgttgcccaggctggagtgcagtggtgcaatcacgtctcactgcagcctccacctcccaggctcaagcgagcttccctccttagcctactgagtagctgggactacaggcgcatgccaccatacccaaataatttttttattttttgtagagacaaggactcaccacgttgtccaggctgttctcaaactcctgggctcaagtgatcctctgcctcggcctcccagagtgctgggattataggcgtgagccactgagccgggccagctcctcactttttgcaggatgagagcctgggcttcctttgatcacgtggagccaattacacctccttggctgttgcgagcttagattcaggagattgtatttccctagcatccaacaggcatgtccaaatgtcatctcttttcttccacttcactttctgtcatgttccctttagcggttgctgtcggggctggtgttctgactgagactgatgaattgttttataatttttccagagtaattgcaatgatagtcatttataggacaggacagtcacgggtcacttaacaactggggtagattctgagaaatgcatcattagacagttttgctgtgtgaacgtcatgcagtgtacttgcacaaacctagatggtgtagcctcgtatacacctaggctatgtggtttagcctattgccccaggctgtaaacctgtacagcatgttactgtactgagtgctgtaggcaatcgtaacacaatggtatttgtatacaggcatatcacagagataaggcagttttggttccagactaacacaataaagctaaaaccacaatagagtgagtcacatgaatttttttgtttcccggtgcatctaaaaattatgtttatactgtagtccattaagtgtgtgatagcgttatgtctaaaaaaatgtgcacagcttaattttaaaatatttacttgcggaaaaatggtagcaatcatcagagccttcagcaagtcataatccttttgctcgtggagcatcttgccttgatatggatggctgctgactgatcagggtagtggttgctgagttgcagtgactgtgacaatttcttgaaataagatgacaatgaagtctgctgcatcaactaactcttcctttcatgacagatttctctgtagcatgagatgctgttcggtagcattttactcacagaagaacttctttcaaaattggaatcctttcaaaccctgctatcaactaagtttatgtaatattctaaatcctttgttgtcatttcaacaatgttcatagcatcttcaccaggaataaattccatctcaagaaaccactttctttgctcactcattagaaacaactcttcatctgttcaacttttatcatgagattggagcaattcagtcgcatcttcgggttccgcttctaattctagttatcttgctgttttcaccacatctgcagttacttcctccactgaagtcttgaaccccttaaagtcatctatgagggttggaatcagcttcttccaaacccctgttaatgttatattttgacctcctcctatgaatcaccagtgttcttaatggcattttgaatggtgaatcctttctgggaggttttcaatttaccttgcccagatccatcagagaaatcactatctatggcagctataactttacaaaatatatttctttattttattttatttcattttattttattttttaagatggagtctcactctgttgcccaggctgaagtgcagtggtatgatctcagatcactgctgcctccacctcccaggttcaagtgattctcctgcctcagcttcccaagtagtgacaccacaccaggctaatttttgtattttttttttagtaaagtcagggtttcaccatgttggccaggctggtctcgaactcctgacctcaagtgatttgcccgccttggcctcccaaagtgctcagattacaggcatgagccactgtgcccagcttcaaaatatatttcttaaataataagatttgaaagtcgaaataactccttgacccatgggctacagaatggatgttgtgttagcaggcatgaaaacagcattaatttccttttaaatctccatcagagttcttggggaaccaggtacattgtcaatgagaggtaatattttgagagaaaactttttatcctgagcagtaggtcttaatactgggcttaaaatattcagtaaaccatgctgtaaacagatgtgccgtcctccaggctttgttgctccatttgtagagcacaggcagagtagatttggcataattcttaagagctctctgattttcaaaatggtaatccagtgttggcttcaacttaaagtcaccagctacattagcccttaacaagagtcagcctgttctttgaagctttgaagccaggcattgacttctcctctgtaactatgaaagtcctagatgacatcttaatagaaggttgtttcatctacattaaaaatctgttgtttagagtatccaccttcatcattttagctagattttagctagatcttctggataacttgctgcagcttctacatgggcacttgctgcttcaccttgcacttttatattatggagatggcttctgtccttaaaccttatgaaccaacctctgctaacttccaacttttctttttttttttttttttttttgagatggagtctcgctctgttgcccaagctggaatacagtgacacaatctcggcttattgcaacctctgcctcccgggttcaagtgattctcctgcctcaacctcctgagtagctgagattacaggtgcatgccaccatgcccggctaatttttttgtatttttagtagaggtggggtttcaccatgttggtcaggctggtcttgaactcctgacctgatgatccgcccacctcagactcacaaagtgctgggattacaggcgtgagccaccacacccagccccaacttttcttctgcagtttcctcacctctttaagccttcacagaattggagtgttagggtcttgctgtggattagactttggcttaagggaatggtgtggctggtttgatcttctatccagaccactgagactttctgcatattttcaataaggctgttttactttcttattattaatgtgttcactggagtagcactttaaatttccttcaacaacttttcctttgcattcacaacttggctaactgtttggcccaaggggcctgttgtggcctgcaatatgccttcctcactaagcttaatcctttgcagcttttggaatagggatgcccgaggagaaggagagaggcaggagagtggacagtgggtggagaagtcagaacactcacaacatctattgattaatttcactgtcttatataggtgtggttcatggtaccccaaaacaattacaacagtaacatcaaagatcactgatcacagatcaccataacacatataatcatgatgaaaagttttgaaatattgcgagaattaccaaaatgtgacataaagacatgaagtgagcatgtgctgttggaaaaatggcaccaatagacttgctcaatgcagggttgctgcagaccttcgatttgtaaaatgcaatatctgtgaagtacagtaaagcaaatcacaataaaatgaggtatgtctacatctaaatgtatttaaacatagaaaaggtacagtaaaaatacagtatcattatcttagggcatcaacgttgtatatgtggtctgtcatctaccgaaatgtcattatgcagcacatgactttattgaaaatcattgtaatatctttattttggtaaatttttgtaaatcaatgtctcataaatcacatgcccctgttttcaaaaatacgtaatcaaggaagcaagctttcttggtcaagtatgctgaatactcaaccccttggagaggcacgtagtcattaagatgttcaagtctctgagaagttctgttttgaagacacgtatttctatgtttaacacagtttccactcccgcgccgcccccccctccaaattaagtaccagtcagcctcagggagactgaagccagaactctcctgattgacctatctttttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattggttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaaaccatatattagcaattgagagagtaaagaagattagaggttaaaagaacctaattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttctttttttctttctttctttctttttttttttttttttttttgagacaaagtctcactctgacacccaggctgaagtgcagtggcgcgatctcagatcactgcaaactgcctccagggttcaaatgattctcgtgcctcagcctcctgagtagctgggacttcaagtgcctgtcactatgcccagctaaatttttttgtatttttagtagagacggggtctcaccatgttggccaggctggtcttgaactcctgaccttaagtgatccacctgcctcagcctcccaaagtgctgggattacagacatgaaccaccacacttgtccttgagcccaggaatttaagaccagcctgggcaacatggtgaaaccctgtctctacaaaaaacaaaaaaaataccaaaaaaaaaaaaaaaaaaaaattagccaggcatggtggagtgtgcttgtagtcccagctacttgggaggctgaggtgggagagtcatctgagcctgggaagtcaaggctgcagtgagccattatcacaccactgcactccagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtacaagtttttgctcctataattgctaactggcttaccaggtcctaacttgtcccaaatcctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacaagttttcttgtctggttttcagacgagcactttagaatgatggaagcaggtccattaacagccctgaaaaagtaacagcagccaaagaagaatacaggacataactcaaacaccatgattgcctggaaccatttatgaatcattctatagttattattgagtacatctgtgtaacagctgcattctgagcactgaagctacaacaatgaacgagacaaaatacctcatggagcatatatgtgctaatcaggaatacagataataaataaatagatacatattacatgacaggtagtgactatggttcttaagaagactgaagcaaggcaataggacagaaagtaatgggagctgcacttctacatagaatggtaagatacagtctctctgaggaagtagcatttgagcagagacccatatgaagtgaaggagccagccacatgaatatctagtaaaagagcattcagaagggaaacagctttagacattgttggaaatatatatggttaattatatatgttaaacatgtaaaggtggccactaaaaataatagagatgccatctgtagcttccatcctgaaaaaggaaataaaattcaagccaacaaaaagcaggaataaaagaggagaagacaccaaaaacataaaatagaaatttaaaaagaaatccttatagaaaatacaaaatagcgtagctggaataattccaaatgtatcagaaaccacaataaacataagtggactaaacttcattaagaaagacaaagattatcagattttttaaaagaaactaaatccaactacccttcttagccatgtcaatcaatgtcatgacaatagtatatcaaagcagtgtacttccgtggactaattgttctgcatggttatgaaaaattaatgttgaagtttttaaaatgtgatttttgattgtcattttgcttgttcttctgcttagccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctcaagcttcccagactcctaagggatatgtgtagagcagactttcaggacaaagtctgcacagtgacagcagacctttccctccctgaagggcagctgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgacacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtcctttcctgctgccacaacaaaataccacagactaggtaacttataaacactagaaatttatttctcacagttctgcaggctgggaagtccaagatcaaggcaccagcagattcagtgtctggtgagcactggcgtgctctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtgagcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgccactgcactccagcctggacgacaagagtgaaactccatctcaaaaaaaataataattaaaagaccagtttattttatttatttatttacttttttctttatttctgagacaaagtctcgctctgtcaccgaggctggagtgcagtgtggggtgatcctggctcactgcaacttccacctcccaagttcaagcgattctcgtgcgccaccacgcccggctaattttttgtatatttagtagagatggggttttgccatgttgactaggctggtctcaaactcctcagtcccccaaagtgctgtgattacaggcacgagccaacacacccggcctgctttatcttttttaaaaaagaagtgatggcttgtgtgtcatttaagctggagaattcaggaaccaaaatggtttgtgggcaccactgtcagtccttgatgcaccccctgagtggcctcagggtccctgaactgagaggagcacctgctacctgctccttcctattttaagtctaaaacggctattatcactgataaatgtgaaaaaaaaaaaggtggtgcccttccactgcttagtcatgttcttatttttgtctccattactagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccaactcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatcctaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaataccagtaatcacccatgaactgacaaaatccaaacattttacaaaacaaaagggtatgagccattgaaaacctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcatacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagtaatgactggagttgggaaaagggccgagttccatttactcagaggtgttttaaagggagaacgagggccggggcaggaggatcgcttgaacccaggagttcgagaccagcctggccaaaatagtgggacccccatctctataaaatattttaaaaattagctgggcatggtgacacatgcctgtcgtcccagctacccaggaggctgaggtgggaggatcacttgagtcctggaagtcaaggctgcagtgagctgtgtttgcactactgtactccagcctggacaacagaacaagactctatctcaaaaatgaaaataaataaaaggagaatgagggagtagaaagaaagaatgcgtggggagttgagcagaatcagggaagtgaaaaaaattttaaatcagctaaggggatgggtcagtgccgtgaggccctctgtgtctgtgaaccggtgtttatcaaggctaggcttctaccctcccacagagacagggagacagaggccctgtacttcctgatgatttcaaaagaatggctcgcagatcattgagaaaaatatccctgcgttgtgggagatacatacatgtctcaaagggacagaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctcttagtgcaggggtttgtttgttttggctttggttttggtttttgaggcggggtttcactctgtcgcccagtttggagtgcagtggtacaatcatagctcactatcacagcctcgacctcccaggctcaagcgaccctcccacctcagcctttcaaattgctgggactacaggtgtctgccatcatacccagctaatttttaaaaaattttttttgttgtagagaaggggtctcactatgttgcccagactggtctcaaactcctgggctcaagtgatcctcccacctcggcctcccaaagtgctggggttacaggtgtgagccaccacacctggcttagtgcaggggtttggatagagttgttcacgcagagtttctgtttttctcaatatagaacgagatggtgcctgtgtttaactcaggctcaggtgtccaggggagtatcacttgctgtgtcaaggcagaagtggtatatccagacctgggaggcccattgctacactgccagtagtaggtacagtggatcagaattcttgcttgttattcttttgatgtatgtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcacctagggcatcgctccttctccagccttcactgcccaaagccccaggtccctgaggagcaaaggtgatggttctagggcaggaggggaaaaacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagaaatgaaactctggatagtcactgacactagagaatgaaaagattccaagcccggacccaaaggaactatctttggtctcatttcccaggaagcagactctaagatagagatttgtattcaaaaggcttgatggggaacatccttgggaataataccctaaaggagtgaaggtagccagatgtggcagagagaggttgagctgtcacacagccacaacagaggcctcagccaatcccatgtggcctctcgagctggggtggccctttagagatgtcctaagctgaggcaagagggatgggcgtgtgaactccacattggccatgcgctggatgtgggctactcccaggaaggggccctaagctagggtgagaggtgagacagcagcagccaggagctaggagcacgagtgcctcattcctgaaggcaccacagcctccattacagtcacccctgggaccacttggatctactggaagcagctcctccaggatctgagttgatctcgtttcctggggagggttacaggaggaagatgagtggaatgcactccagcccccaccgctgctgctggtgtcgggaccacaaaggaatgcttgtgggctggctccttcctccgctgccctgagggcccgctctcctctcccgggaggagcctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccaggaggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctactaaaaatacaaaaaattagccaggcgtggtggcgggcgcctgtagtcccagctcctcgggaggctgaggcaggagaatggcgtgaacccgggaggcggagctggcagtgagccaagatcgcgccactgcactctaacctgggcaacagagcgagactccgtctcaaaaaaaaaaaatacaaaaatacaaaaattaacccggcatgctggcgcatgcctgtaatcccagctactcgggagactgaggcaggagaatcgcttgaactcgggaggtggaagttgcagtgatccctcacaccactgcactccaccctgagcaacagagcgagactccatctcaaaatttaaaaaattttaaaatttatatatatatatttgaggttctgttggcaagaaataaaaatcaaaattatgtagtcacttatataaccacttaaatataatcatttaaaaatccgaaagccatgtgaaaaaacaagtggtaggccggatctgccccgtgggcctttgtttgctggccctgccctagacccacagagcctcaaatcacaaggccagggagcagcggtttccccagtaggtcactgggcatgatgagggtgaacagggccactcctgccctgcgcttgcttcctgacgcaggtgttccacctgctggggacacagccccacatgattgttggtcttgggtgcatgccaggggctggaggacaatgccttgccctcaccaggtgtcatctccaagctggcgcctcccctgcactttcaacaggccgctccgtccttcttccagtctggcagctgctgggtggtgcagggtgggatacgaccaggggggtcccgccttcactgtcagtgggcccattggtctggcaccatgtgatacggcgtctctactagtttgtcggggctgctgtagcaaagtagcactcgttgcgcagctgtaacaacgggaattgattctctcacggttctcgaggccagacgtccaaaatcaaggtgtcactaggatggtttccttggaggctgtgagggaggatctgtcccaggcctctaccctaacttctgagggttgctggcgatctttggcgttccttggcttctagaggcatcacccagtctctgccttgatcttcacaagccttctccctatgtgagtgtctgtgtccacattgcccctcctttatacagacaccagtcacgggaggagggctcaccctgctccactataccctcattctaacttaactgatcccctctgcagcaaccctatctccaaatacagtcacattctgaggtagagggattaggacatatgaatttcttttttttttggagacggagtctcactctgtcacccaggctggagtggagtggcatgatttcggctcagtgcaagctccgcctcctgggttcaagtgattctcctgcctcagcctcccaagtagctgggattacaggtgccctccaccacgcccggctaatttttgtgtttttagtagagacagggtttccccatgttggccaggctggtctcaaactcctgacctcaagtgatctgcccgccctggcctcccaaagtgctgggattacaggcgtgagccacagcgcctggcccagaacatgaattttgtaggaacagaattcaacacctaacaggatcctctaccaggagagaaaacacctgtgaaaccttgggaatcctgacaggccctgcaggacacgaacagcaaatcactcctaaactaaaggttagctccagccaggatgcaccactgccccttccagagtggtgcaagagtcgacgtcatcagcttgctaccaggtggctggtcagtctcctcggggaatgccgtcatatcaggggctcagcattgatctctgtcgcaggcaggttggacattccacagcagtggtggctacccagccgtgggagtgggagccccttctttcaggcccacgcgcagcctccatccctgccaccacggctgctgtgttcatgagccctgtgccatgtacaggtgaccagtggcagaggctggctgacatccactggctgtgtcatcatgtctccctggctgtctgctgtctatgatacatgctctcagtgggagttaatatgggatgcagaaatctccacgctccagctactccctcaggtccatccttcttcccaaacgtccttgtccctaaccttccagtcttccttccccagggcccctgaccaccaggcttgtcactaacccctgcctgggatcccacagctggcctgatcttgggctgcttttctttccacataaaggtgatgatcagacccacggcccaaagctctgcccgtggggacactttctccctggttggggctgaagtgcagcagcgggccactttcggtgtgtgcccacataccatgctaaccttgccatgaaaccaggccggcctttcctcctacttctgctaggcataattacccatccccctttatggtcatcatgtgagcagacacagacacggtgcgacaggggtagaggggacaggagtccgagccacctgcatgtggccaacatgcaccctctgaccccatctcaggacctactgggtctcaggcctcatgatggtcacttctgggcagcaccatcacctcgcgtccctcgtcagaagctctgtctctgccgggaccccatagcgtcccaggagctgctttttcaaacagagtacaattatctgctgcagatggccccgcctgaccccagaactctcgtatctatgttgtgactttcctcttgggatttgccataaactccacccagcatcttttcccaccccagacacttcaaggatatgcgaagtcacacattccccaggttggattcacaggccgtccctggtgggtaatgtaccagtcctgaggtgtgcatagggctgcaggctgcacggcccataccttctgcagggccctttcctgcctggggcccctccgtgccagcagcctcctgtgtggtttgataaacatattggaacagtcagtattcctaggcgtggaacatgctgcctccagaaccctgaggcctccacagcacaatgcttccttcctagtggtgggaggggcaagatacaataattggtcctttaaagaggatgtcctggcatgccccactgcaagggtcccctcaaatatcacagatgtggcaggtccctgaatctctacagggtgagtttctcaccctctgcagtgtgtgtgcctcaccaatgccttgccacttcttggcgtgtctggtcctattaatgtattgttgtgatagctaatatcaggcccttgtccccgcaccaccagtcagctgatgcaggctgcctctggcaagggcacagagccttgaccgaggcaactgccttctgggaagggcacagcctagaaagggactcagctgtgagccatttcagcctccgatattcctggaggctgggggaacaagcgcctcctccacaaaagggatctgggcaacatagcactgcatctaccctcgatggcaagtggggcacaggaccataggcaagtgtttcagagcgactagaaccccctacagagagtgccaggccgagcatggtggctcacacctataatcccagcactttgggaagccaaggctggcagatcacttgaggtctgaagttcgagaccagcctggccaacatggtgaaaccctgtctctactaaaaatacaaaaattagccacgcctgtaatcccagctactcaggaggctgaggcacaagaatctcttgaacccgggaggctgaggttgcagtgagcagagatcgcgccaccgcactccagcctgggcgacagagtgagactcgatctcaaaaaaaaaaaaaaagtaccaaggagactgcagcaccagcatgaactaagaatcctctatgagcttttgagaagccacagctgcagcaggaagaacaaagaatgagggtgggccctttgcttgggtaaaaggtgttgtgttaactgagaaccaaaaggaaacaaaattattcacctgctatttttgcttctggcttcaccatcagagaaactggtcagacaggaaagaacagacggaatgaacggtagaggggcctgctggcataagctctcacctccgaggctagaagactttgcagacttgaccgtggagccagcccctgtaagatctgagaaatcagagatgggagtggagggtgctggagaagggccaggcaactacggagcagttcgaggtcctcacatcacgactttctccagcttgactcataatgatagaatccattaaccaggatccagaggatcatttcgagttcagggagatttgctaggaatggagactttgagttaaaaaagcactagggaggttcatcctacactgatctattgagccagccaccagtttgtgtgtgtgtgtgtgtgtgcgtgtgtgtgtgtgtgtgtccaaccgggagactcagctgatactgcttccttgagatttaatacaccttcctttgatctctcctgtccccattatcccaggaaaatccagagtagcttccagtccattctcattaatccactggatccaaagtttagagaggttccccttccctccagcctccttcctggcccaacagaggagcaccccaccaccctccatcagctgctcaaaacccacaagggaaaaatccctacaggtccatgccaggaggtagtggagctaccctcaggttccattaagtcataccagaaggctgagtgtagaaatgacattaagaggggttccatctgtagggaaagggttcaagatgcaaagctttacagaaggttctccgtctaattgtgaagattaagagcactggtggacctaggaagatgaagaatggagagtgggaaaccagcagagatttcaggaaatgtataggggcatcttcatcgttcaaagcaccggagagacaaagattattagactgtggtccctgcccttaaggagccctggctacaggtgacacaaactgagaagagttggtgtctattaaaagtgagaaggcagctctgtctgatagagcatattgcaagccatgtgtgttttagatttgctagtagccacatttttaaaaagtccaaagattgggccgggtgcggtggctcacgcctgtaatcccagcattttgggaggccaaggtgggcagatcacgaggtcaggagatcgagaccatcctagctaacgctgtgaaaccctgtctctactaaaaatattagccaggcaaggtggtgggcgcctatagtcccagctactcgggaggctgaggcaggggagtggcgtgaacccgagaggtggaggttccagtgagctgagatcgcaccactgcactccagcctgggtgacagagcaagactccgtctgaaaaaaaaaaaaaaaaaaaaagtccaaagattggccgggcatggtggctcacacctgtaatcctgacactttgggaggctgagacaggttgatcacctgagatcaggagttcaagaccagcctggccagcgtggtgaaaccccatctctactaaaaatacaaaaattagccaggcatggtggcgggcacctgtagtcccagctactcaggaggctgagggaggagaatctctggaacctgggaggcaaaggttgcagtgagccaaaactgtgccactgcactccagcccagacgacagagcgagactccatctcaaaaaaaaaaaaaaaaaaatcttcgtttgtatagcagtgagtatccccacttgtaaaaaaataaaataaaaataaataataaatcaaaagatgccagaggccgtggctcacgcctgtaatcccagcactttgggaggccaaggtgggtggatcagctgaggtcaggagttcaagaccagcctggccaacatggtgaaatcccatctgtactaaaaatacaaaaattagctggcgtggtagcacatgcctgtaatctcagctacttgggaggctgaggcaggagaattgcttgaacctgagaggtggaggttgcagtgagctgagatcgtgccactgcactccagcctgggtgacagagcaagactctgtctcaaaaaaataaaataaacattaaaaataaataaataaaataaaatagattttccagccaggagttctgtgaaaaaatctttgtaaacccagaaaaagaaatggagaaaattgatcattaactgtcctctttccctccacagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgata

SEQ ID NO: 1788 - DNA, 15691 bp, Homo sapiens
  source 1..15691: mol_type = genomic DNA
gattacaaagaagagtttttattagttcagcctcagaatgcaaaaataaataaataaataaacaaacaggaaacaaatgtaatcactttacagagcgcacatacattacttaaaagtagcaccttcatggagccatattttctggtcataattgtgtatcaggttcattcatgctaatgagaaagggattccagattttctttgcatctgtctgcttctcacagggctgttaagaagccacctgccattctgacaatttcatgtccttagccataactacttgtcctctctcttgaatcttaagatctttttgccttccagacacttacggtgtttctgtgtcatcctcctgtgtcttttagagaggtgggggtgaggactgccatggaagctaaagctgaattttaatttcaatcatttttttttttgagacagggtctcattctgtcacctaggctggtatgcagtggcacaatcacggctcaccatagccttgacctcctgggctcaagagatcctcctgcctcatcctcctgaacagctgggaccacaagcatgagccaccacgcctggctaattttaaattttttttgtagagacggggtcttgttatgtttcccaggctggtcaatcatttttttctagcccttttaaaattcaggcatccaaagattaaacttgcttagaagtgtaagtggccctaaattgctttatcaacaccatctccaggaagtcttcacagacatgggaactagcatcttgttctcctggatcttctcaacaggtttgcattgtcaggtttccatgtaagtatctcttgcgttcccatccatcacaagtgtatgatggcactggtatcagaacactgcattcttcctgattgtcataaaactgatgtacttgcagccttgcttgaaaagttgtcagtacaaataaaattaaattcacattttgcataatagggactgatcctgatggatcaggtcataagagtatgaaacattccatacatcctggcagacaaacgttaaataacagtaatatactaataaatacataaattacttaaatatttaaatagcatgaaggcccatggcaacttgagagctggaaaatctatacataaattagctgattgtttcaatgagcatttagcatctaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaacctggaagagaatgccaaaagttgatgtggggtgacattgtaacagcaatgtctcttcttatttctcacaacatatgatcctgggcaactgggtttcagggatttcatgccagaaggcccaggccttccttatgtggcctggaatttggctggcaccatgcttgccagaggctttcttgagggttttcttaaaataatatctgattgtgttacttccttgctgaaaacccttcagtgggtttcagggcccggggcccccagaacaagattctgagtcctgcaagcttgcaagtcctccatgctctgcctcctggctacctctctcttttctttgcctttctctttaggaggccagaaccccggtctgttttctttcctgcaatatccctgtggccagcacagtgtcctacataacaaaggcaccaaataaatatctgttagtgaataaatgtatgtttctgattctggcaactgggtgctggccactccatccccctttcctctccaacacagcccccaatcatatccctgcatccaggtgcactgagagtgcaggcctgggctggcctttgagggcctgctcacctaactgcagggcacagatgcccattcgctccaagatgagctatagtagcggtcctgggcccgcacgctaatgctggcatttttgcggcagatgaccgtggctgaggtcttgtccgtgaagactctatctttctgcaaaagagaaggaaagctgtgaagaccccttggcaacatagtcacagggtaagctgagcctgtttctgcaatgcatactctcccaaaacaagcccatcttggtcttagggcactgtgcttgcaattcacaggggtgtgcatagaacttgcaccacctactggcagacactccacatgtaggtgcagcttttgtactttgtaagcccttgagggagaaatcgtttggcccagctttcatctttctagcacaattgccttgcctcaagaccccatggccactcacccagtcctgagctgatggtgagagagagacagatttgctctagccatccctgagatattgagaaataccatatcctgatcatttcatcagaaaacttgccttcaaattctggcactgctacttaatagctgtgtaacttcaggaaaatgtcttaggttctctgtgtctgtttcctcacttataaatagggataacaataatgcctacttcatagaattatagttcaaggtaaaaatcacgtcaaactcttagcaagtctttagcacataggaagcactcaatatcacctattagtcatacagatcttaaatagggaaagtacttgccaagatgtaaaataatatttaggtaaatatctattccaggatagcctccctacctaattattttcccagagagtaactagctcactgaatttctaccacatgctaaatgctatgctgaattagggctttgtccagtgattttaaaagtggggtgaaaggagtctggggcggtacaaaagggcctctggaaccttgcaacaggcaaaggaattctgctgtaaggtgaggaagctgggaagccaatatcttagcctctataagtgtagacattctgtttagtaaaataattttataatatctggaacagccaggagctatccattttgggggcgatatctcttgcctgttctatcattcattacatgcactcagttgaaacaacaattttaggcttctggagcccaggtctcctctatcaggactaattctgagtgccaagatcaatgaccaacatcagaggtagtggagtggttaggtgcatggcctttctgtctggcagattgagtttatgtcttggttatgtcatttcctagctgggtgaccttggtaaagtcacttaacctctctgagtcttcaatcacttgtgaaatgatgataatactactggctaccaaccatccttttcttggggttgggctactgtccaatgagcacgtagtgagggcagtgctgctaacacctacacaaaattcctgcatcagctacagctttactttaccttgccacagtttctggaaaaaaggaaagcctcttttccacaaaaaagggggtaaaaaaacaagaataacatcagctacctttgttgcgttaattttgtagattaagtgaaataaacatggaaaacccttggcacagctctagacacatagaaaagtgctaagaaaagtaattatgcatcacataataacatttcagtcaaagaaggatcacatatatgaccagtggtcctatattgttataatattgtatttttgctatatcttttctgtttagatatacaaaccattgtgttgtaattgcctacagtattcagtacaggaacatgctgtacaggtttgcagcctaggagcaataggctataccataaagcctagaagcgtagtaggctataccatctaggtttgtgtgggtacaccatatatgtttgcacaatgatatagctgcctaaagatgaatttctcagaatgtatccctgttgttaagtgatacatggatgtcattgttattatcatcattcatcttctcactttatggtgggcctccgtaaaactgaccaaggaatatactgcacctgaatcacttcttaccttttctctcttgctcttgccctggacctgaacgcagaatgtcagggagaagtaggaatgtggagtactccaggtgtcagggtactcccagctgacctccacctgccgagaattctttaatggcttcagctgcaagttcttgggtgggtcaggtttgactgtggaagaggataaacatgctttattttcctaataaggctttggagttcagtggttttggcttatgatctcacttgcacctttgatcagctgtgagtccactggatagttacttaacttctgtgagcacctggctggcaaatgtgaggcacctctgccgcaggtgctcacgctggtgcctcgggaaggcagtcattatcaatggccacatctcagatccacatgtattgcaggatctgagagatgctcagaatcctcatcactgaacaatcagatgggaccgcacagtgagaagacctctgctttaatggttatgggccatgcattgaaggaccaccctgtctgtgctaatccctcactttgcactgaacatggaactaagctgagcctctccctggggatgagatgatagattttctatttactgccctttcttttgtcttttcatagcttttggtgcggacatgtcttggagcagttacagtcaattgtctctatgctcaatttgcttgtttattccatgaatactgagcgcccattatgttccagccactggactgtgcatgaaggatacagcagtgagtttcacaaagactccttcctcaattaggtcttctagataagaggaggcagagacatgctagggtgtgtggttgggctctgtaggcctggcactgctccacacaaagatcacggctcctagcaggtgcttcgcacatatgcttccctctgctcttaacacaactgacatctttccttttggtgtcagctaaatgtcacctcctcagagaggccttccttggccaccctatgtgaactagaccccacccaccaagtacaaaccctccataagttttgaagcaagttctctggttctattacactttatcatgctgcctggtcaatgaataaatagtaaaggaaatgacttatggtgaaatccctatctgccaattaaaaaaaaagatgtccattttggaagggtttatattctaagaaagaagtcccttttcaaatgctaaggaaggattggttgggaataattgccattagtaaggaagccctggttctgaatatgaatattatgcttgattaggctctgggattcatcatggaaactatctggcagctgaatcaaagtgcagtaaagagcagctgtagtggagtggatctggatttgaacggctagctgtaagatctgagatctggggcaagttgcttaacttttctaagactcaatttcctcttccttaaaatgcagataacagtatctacatcgtattttgtttttggatgcagaataaaagagatgatgcttgtcaaccacctaccccacagtgcatggggcattgtgaacacgtgacaaatagtatctttccttatggagcacatataatcatccaaaactcactgatgtccctgatgaagaagctgctggtgtagttttcatacttgagcttgtgaacggcatccaccatgacctcaatgggcagactctcctcagcagctgggcaggcactgtcctcctggcactccactgagtactcatactccttgttgtcccctctgactctctctgcagagagtgtagcagctccgcacgtcaccccttgggggtcagaagagctgaagtcaaagacagaaattagcctgtgttacacattggggagagagttcctagtgattgtagccagtaaggcaggtaaggcctcaactgttgtctgaggacacagtttctccaactgggctgatttctacccagagggtaagaaactgccctccccaggagaaaaagcttaaattcaagagcacttacatgtctctggactaaatgaatatggaagtttttgtttgttttagatctagaatctctgattattaaacccccttgttaaaaacttaaattcattttttcccattttaattataaaatcaatacacaaatcagtacacactaattataaaagtaaagatgataaagatccatataaaggaaagaagtgtatgtctccttcatccttaactgctctccacaggtttaagtactaataatagcttgttgtatccttccagaccttcctttttctttttctttctctctctctctctctttttttttttaagagacagggttttgctctgccacccaggctggagtgaagtggtggaatcagaccccactgtagcctcaaactcctaggctcaagtgatcccctccctctgcctcccaagtagctgggactacaggtgtgtgccaccacacccacctaatttttttatttttaatattttctgagatggggtctcactgtgttgcctaggctggtcttgaactcctggcctcaagcaatcattctgtctcagcctcccaaagagttaggatttcaggtgtgagccactgtgcctggccagaactttttcaatgaatattcaagataattgtatacacattttatatatatatatatatatacacacacacacacacacacatatgtatacacacattatatatataatccatgttatatacatctctacattatatatatccactatatatattttacttatacatatagattttatttttatgaactaggatcaaattgtatacatatgattatgtaaccatccttttcccctctgaacatattatggggagctctccatgacaaaacatatgggttgggttatccacttcaatgactgcacattaagcaagagtatagtgtaccatgttttatttaaccattcctctgctgattatgtctttatgcacttggagaaacatttctttagtaagcattttccttttaaagatgaaaaagtgagaccccaatgcttaatttactcagtgaaataatggtaaagtcaggatgatcacctggggtttgcttcggtgatgattaaagtaagccacatgggggttaacacataggtcttgtatttatggaagttgctttcttacggaaagtccaggtgcattggaccaacagcgaacttcagattagtggtgtcagcagaagtaaaaggagttgaggtggccctgggaaaatttcgggaggcctcatcgagttttggagtctgcttcagggcccctaagatctacgccctggagctcttgtttttatttttgactcaaggtgcaatttcagcaagtcatttgtagctttgaattctccgtttatccctttctttggtgctatgaggcttcaggaagcatggccaggcaatttggatgagtgggttcaaacacagcagagactattctcagttcccaataatatcctgccccaacacatacatttattcaagcaatcggctaaaatctccatgttctttcttcaatgtagacaaggaagggcggttgaaaaaacacgggtttgactttgcttttcccattatcattaactgataggtcactgagaggttgcccttaatttcttaatgaaatagttctagaaaaatgctgagaaaccagagcagtttcactcaccctctgctgcttttgacactgaatgtcaaatcagtactgattgtcgtcagccaccagcaggtgaaacgtccagaataattcttggcctcgcatcttagaaaggtcttatttttgggttctggatttgaaaaaaacaaaaattcaatatttaggagttttttgcagaaaggttttgattgtgatgaatcacagatcaccagatggtacagggtgaagttcttccatgcgttgcctcttgggtagctccataaggattgggagtatcccagtggggtgttgattctgcagagtacactacacacctaacatgcctggcagaggcattcattttttgaaggctatcaccccagtgcagagtgatacactatcggttaatttccattagccattaaataatatcaccattatttaaagaaaacatgaggctaagcattcagactgatcatgaaactcccttaatatgagattttgatggttgataacccaaagggtccaggaaagcaaaggaaaatggaggttaacatcaattaacatcaataagagacttgatgttaattcattacactcaccatgacttggcttttcaatttgttgttgttgttgtttttaactcttatgagcgaaagagaaaattgatactatccaagggtatagaattacctttctggtcctttaaaatatcagtggaccaaattccatcttcctttttgtgaagcagcaggagcgaatggcttagaacctcgcctcctttgtgacaggtgtactggccagcatctccaaactctttgacttggatggtcagggttttgccagagcctaagacctcactgctctggtccaaggtccaggtgataccatcttcttcaggggtgtcacaggtgaggaccaccatttctccaggggcatccggataccaatccaattctacgacataaactggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaagagttttatagctgccatcgactcattgactggaaggctgcctttaatagtaacctttgattatttagcagattggaaacaccttaatataccaaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatcgttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtcacagcaagtcagaagtacaagggctacagctcagaccttttgtctcttgggctttgcaagggatgcctaatgctagtgtctaaactggcctttgaggaatggcttagtatagtatttcagagtgtgtcatagcaaagcttcattcatttttttaatccatgcataaattattaattgaatagaattgtttaatgtagtagttcccaaagcatgatcgatgaaacaccatcagcagcatcaccttggaatagatcagaaatgcaaattctcagctgctgaatcagaaaccttgggatggatttagttatatggttcttaagctctccagatggtgctgatgcctgctcaagtttatgagtcacagtggttgagagcctgcattttggagtggcagaggcctggatttagaagcagctctagcccttgctccagtcttgtggcctttggcaagacattcaactactgtaagcctcagtgtcatcatctttaaaatgagaaaaatattagcccttgctttagaaggtggatatgtggattatataagctcatacacagtgcccttacatgctttataaatggtggttctcgttattggcctctggatgtaaagcattgtagaatataaagttttcactttacatcaattggattataaggactgaatggataacaaaaataagaggtcaaaagcatttggggtccaactctggggaaatgattagctgtgctgatgtaaaaccatgtggcacttttggctttttcttggttttttttttgtccccctgacacctgaagagcatggttactttcctgtcccaactgaggctcggaagccctagaagatgtttgctcaacagcagggaaaacagctgcaggaggaaagctgaagaggagcatcaagaacctggcacttagcctcactgcatcgtctgccctcctaagtcacacctcggagagtttctcacactgattttctggaatttctgtggtttaccaaatcagaagtcactaaggggtcaaatatgccaggaccaaggttcctgagctcgctaacaatcccagggttggaagggatctgccatatacccctggctcaggcctttgcctttacttaagagagtgtctaaatctctcaaattctcatggagaaggggtggctggattctgtcttcctaaaattcttgagaagagaggagtggtcccagatttctttcaggtacccatttcaagatggtactttctagaatatcaaaagattatttctgatcatcagctgaaatattttcatccttaatttatgtccatttcctcttattcagctctccaaagacctgggaaaaaattacttcatgtccttgtaaaaacgttttcacaaatttaagtgcaccagctttgaagcaagacagaattgggatcaagtccctgttccacccttaccaggtatgtgacattgggcaagttacttaatctctctggcctcagtttccaacatctgtaaaatgggatacagacagtctctacttcatatggctcttgtgagaattaagtgagacagtgcactcaataaacattaactattattattatacaattaaagatagtaatcgccaacattatgatgttggcttcagtgataaaaatctgagggtctttcaggtacagccaacggtcagaatgcacatttactgagtgtgagatactagaaggatgggcagaactccttattttaccattaactattctattagtctactaataatttttactgatcattgggataataaaaagtatctcttgaatcatgaaagatattttaaacaaccaaaatagtaatactagctgacatttactttcactttactatctgtcgagttgtattctgcattcattaacccactaaataacccacgtggtaggcatccactttgtaacatccagtttacagttgaggaaattcaggattagaggtgacccagcttaaagtcacataaccagtcattgacagacctaggacttgaacccaagtcaatgtgagtctgaatcctatgcttcctccaaagtgcttggtcagaggtaagtcatcacagtgccaactgagggggcagtatcatgtggtggaatgagaaacgaacacagttgttatactttgcaaatcctctactttggaattttaattgtgtgaaacagtttttagtaatattggaaaatatcatatgtcatatgtctttccccaccatatcatatatcatatgtctttccccaccatagtgtaccaatgtcatccaatgtgaaaaccaaacaatatagataccatcaaagtagaaaagagagatatggcattgcattttcccagagtgatggctttctctagaggacccagtgcatggttgcccatttcagtttgatttcccaccagtggctgcccaagagtcctggcttagaagtggggcctccacagagaataatgagaggctggttaccatctttcttcagttcccatatggccacgaggggagatgccagaaaaaccagggaaaaccaagagatgaccaactgctggtgacacatctataagaagggagagaagcagggggaagagaaggaggaaaagagaaggaagaggaagaaaaaagagaagaaagaatgtcaataattcttgttacctttgtgaaccatatacacattctagctactttttttttaaataaaatcttgattctcccctttcttctccatactgtcaagcaaatactaagtaaattacaggagttctatggcagtctgtggggaagaacatctctaaatagagaaccatagggtatttggggctctggagctgaaagagacctaaggcaagccatctgatacaatcctcttatttttaagatgagaaacttaaagcttagagaaggaatgtgactttctggatcaacatctagcagttgtttatttagtgcttactacataaagagcactgggctagaagcagttgagagagaaaaaaagggcttacctggatcccgcttcctaggagcaaatacttttactcaataaatatttattaagtcagtgtgttaaatgcctccccgccagctggggagatgagccatacatttgtatcactgcagcacaaagcagtgtgtgctggagcacccagaactgaaggacttgggttagggacaggaacggtaatacagaggcgaactttcaggttctggcaacgacctggtcaccagcccttgctgtaggggtttagcttctcttgttttccaagttcaaagactactctctcccatatagagaacctagtggttctaaaatttgagtgactgtcaggataacctggaagcactgctacaacagacggctgagtcccacccccagagtgtctgattcagcaggcatgagggcctgagaatatgcatttctagaaagtttccaggggaagcagatgctgctggcgctaagaccacaccttgagaaccactggtttaacccatgttcagggtccagaacccctgaaaatcaaagtgttcattgggaaaagaccacaacatattgatatatccaccatgaaatagtaaaatgcataattttatgttaaataagccaccatctgatatagaaaccagtctaggttagtatccagggtttatgaaaatcttccgattgcaaaaattacatgccacttacgaatgaggtagggatgattattgaaacattctgaaacaactccattcaccttgcagagcacccatggtctggaggaaagtggttctgaaaccactgttttaaactatatgaagggcaatgctcaactgtttcagtcaaataccttaaaaatgagcattcctgggttgggtgacggaatattgacaaattacagctttgtcagaactgctactaactctaggcggaccttgctatgtactttattcccttataaagtttgtgagtggcagagacaggcctagaagtcaagccttcttggacactgctcagtgctgtcaccacagcatggagttttaggggcatggctatcacttcagtctaggttatgactgtagcaaagtactagctggcacagggcaccggttagtacattcacaggcttgaagttaaacagacacaggcttgaattttggtcccaccgctcatttgctgttgagcagtgggagcaacttgttggccaagttactcgctgagcctcagtctctttgtctataaaatggacctaatacttatctcaaaggcttgttgggaaaggcaatgagataacatattatagaaggcaaccaataacatattaacttgaacctagaggaagaggtaagggaacaattcggtatctgtgttttatatatcatggatagtcaagaaagtcattctaggcagtagggaaatgtgcacagaggtactgcaattacatgcgcctgtaaaacccagaggctggcacactggaagggaaatagtggagattcctggcatctcctggccacttacgctgaggtattcccactagctgtgtgcccagcacttcctctgcatgcctcagatgcatttgacaatctcaggtgaactgcacttcagggtcaagggaaccccggccatggttctaagaagcaactcccattttagtatcacctacatttgaaaccacagagcactgtccaggagaggtgatggtggtgggtctcctcctttggctctctggcccatcagctgatactagggagcgctatccctcagcccacatttctcagcatggtaagtctgagagtcttgatgattaaaacacatttttgtgtgtgcaatttcataggttttctaaactcttgaaacccttgcatgaaggacaaagggaccccacgttacacactcctacttcctggagtatgctaagggcttcccaacactggtgccaacatcagcatgccaatgacgcttgggtgggcatctcttttttaagttttgtttgttacctttaattagaaaagggagttattattaaagaataaaaagatatagtcacagatggcatgggtggcacatgcaaagatccctagtttgagggccaggcagacttctagaactgtgtgactctgggtgagtcacttggcccctttaagccccacactcctgatctataaaatgggcatgctactgtggtaaggagttagtgacataattcacgtgaagtgtcatggtgcctagatgaagtcaggacccactatttgctcccctccttccacagcatttactacaatggcaacaatacagtctcttctttactgtttgtcttctctgccacactgagtgaactctcttatgccatggatcatgtctatcttgttttgcactttacccccagagtccagcacagagggattccatgacttattagtagcatgaaggaatgtacggaaatcatacaatttcagattccagtaaactaaactctaagaggttacccacattccatctagtatcttgcaattccttgtttgaaaaagtgggtcatcacctggggtttagtaatccctttgttaaaatgacattgttgttgcacacaattttacctgggcaagtaaaaaaacctttttttcccccttctcacagatttaaaaactctttaggaagcaataatagcttttcattttttaactggggccaaagttagttaatccacaagaatggggatcccagctgtcattttggttgatatcacaactgacgaccaagaccatcacaaatatgggagcaagtctgatttgtaacattattataattatgaatccaattactttaaggaatgcacgaaaggctttttaaaaatttcaatagtaaggcaggcaccactcactttagctctatacaatcctttaactgatgggcattaacatttaggaatatacttttatacatcaatacacaccacttcaaaataagataaaacaaacatttccacaaactatgcatacacacagatcttgctatacagttattattaggtggcttttaaaatggacactgtacatcggtccctagagtactaagttttcactaatgttccagcagatgactcaccagggatgcttccaggaatccaccaactccctcctgccagctgctggggtagcacactaacggtttctacacctggacagctgcaggcccacagggaggggagggaggtaggggcttgggaagtgcttaccttgctctgggcaggacggagagtccaatggccctgaaacag

SEQ ID NO: 1789 - DNA, 27327 bp, Homo sapiens
  source 1..27327: mol_type = genomic DNA
gctacgtagcctcgggcgagtcactcaccctctctgagcctcaacgatcacatctgtaaagtacaacagtcatggttcctttcagggggtggttgtagggatttggtagggaatcatgtgagtggatggaatgggctgggtatgccataagtgcttaataaccagccgttgtgattgagatagtcgctcttcgtgtctgtaagacaaagtggatgttttcgtttctccctcaggcctccaggccctgatatcccaggagcgatggatgtctagcccccccaccccccgggcagggttgcacccctgaccgtctggcccactgggccccaggaccttggccttgcacctgtctccatcctccaaggacaactctgtatccagggccagctcaggggcaccctcaggtagctctgtcttctcgagaggctcagtcctctcgcctttgtcccaggacatctctaccaccagggcctcctgcagggatgcctcttcctggaagtccactgggttgatccactgccaagtctgcagagggagggtagggccacagctgtgagcagagctctacttcccatccacagcaggatggaacggaccaggtcactgctggttaaattctctaacatcctgagacctggacgggtgcagtggctcacacctgtcatcccagcactttgggaggctgaggcgggtggatcacttgaggtcagcagtttgagaccagcctggagaacatggccaaaccccatctctactaaaaatacaaaaattagctgagcttggttgcgcacgcctgtaatcccagctacttgggaggctgaagcaggagaatcgtttgaacccgggaatcagaggttgcagtgagccgagatggcgccactgcactccaggctgggtgacagagcgagactccatatatcctgagaccgatttgaggatggagtctgccgcactgactcccattcagcccctcttaggaagagcactcccatctgtctttgggaaatttccctccctcttttcacagatggtgtggttgacagtgcagtgaccccacctcagctctagcaatggtcatgtgaccctggccagcccacccatcagacccttccctacccctctggttctagccataggctcagggaagggcatgtgacccaagctggaccaatcagtgatggccctgagacttttgccccagttaatggggaaaatggacaccctgcttccaatcagagaaggctcagcctgcctgcggaagaaccctgaacgggcagctccgagatagaccccaatcgctggattcaggcatatctgaagcccattcccttgggattttttccatcaggtttcctttataataaagccactttgaattctgtttctagtgccaggaaatggacctctgcctgcctgtctttaaaatgggaaggggtatggagcactggttttggagtccttaccttgatgaattgggagagaataaaatgagctaatgcgtaacccttgtccagcatgtgcacccaataaaaagacttggaattagaaaaggcatccttacctccttccctccagggaactcaatggcggagctggcacagggtgtgggcagcggcgggcacaggtgccgtgcggccctggggaggaaaggggaccagtgagaggagctgaggttttttttttttttggagacggagtcttgctctgttgcccaggctggagtgcagtggcgcgatctcggctcactgcaacctctgcctcctgggttcaatcgattctcctgactcagcctcctgagtagctgagattacaaacgtgtgccaccacacccggctaatttttgtagttttggtagagagaggtttcgccatgttggccaggctggtgtccaactcctggcctaaagcgatctgcctgcctcagcctcccaaagtgctgggattacaggagtgagccaccgtgcccggcttgaaagcagctttcaatcagacatgcccaccagtgtcaccgcccctttccatgggaatgaccaaggacccaaaagttactatcccttccctagaaatttctgcataggatcacctgaggtcaggagttcaagaccagcctggccaacatggtgaaaccctatctctactgaaaatacaaaataaatagctgggtgtgatggcacgcacctgtagtcccagctacttgggaggctgagacaggagaatggcttgaacccgggagggggaggttgcaataagccaagatcgtgccactgcactctagcctgggtaacagagtaagactccatctcaaaaaagaaaaaaaaaagaaagaaattttgcataaactgccccccttaatctgcatgcaattaaaagtaagtataaatctgactgcaaaaccgctctcagcggctactctccgcctacagggaagccctgctctgcagaggcagtcacggagctataactgctgcttcaataaagctgttttcttctacctctggcttgcccttgaattatttcctgggcaaagccaaggacccaatctgcgggctaagctccactttagggctcccctgcccagcatcattaccatcgctatggtaacggtaagaggtgtcagttacctgttcaggccaaggtagccaaggacgcccacgagaaggatgctcaggaagctccccagggaggcgaagaagatgagccaatcagaaacctgcacttctgaggtgggagagcgtgggttggcagagggctacctcctgcctcttcctcagggaaggagctaggagggcctggtttctccatgaacttgctgctgatcctggtgcacatgccacgggcttctcactgggagaccacagaacccacctgcccggtagctgtcaagaaataaaggcctggcatgcaggaagtgttcaagactctgtaattccaggccgggcacagtgactcatgactgttatcccagcactttgggaggccaacgtgggctgatcacctgaggtcaggagttcgagaccagcctgaccaatatgatgaaacctgtctctactaaaaacacaaaaattagctgggcgtggtggtgtgcgccggtaatcccagctacttgggagggtgagacagaagaatcgcttgaactcgggaggcggaggttgcagtgagccgagatcgcatcattgcattccagcctcggcaataagagggaaaatctgtctcaaaaagataaaaaaagactctgtaattccaggagcctgcacatagggcacatgtggctgcccctggacccaggcctgcctgccccccaccaaccctgactcttttgttctctgggttccagttggttctcttggaactgaaaggacaccgtggcatgaacagggatcatttgatctctgaatctcttataaccatgcacccgacaacagagcctgtgttgttctcttcctcctcctcctcctcctcctccctcttcttctattcctcttcctcttcttcttctttcttctccttcttcttcttctatttttttttttttttttttttttttttttttttttgagacagggtcttgctccgtcgcccaggccagagtgcagtggtgcagtcacggctcactgcaaccttgaactcctggtctcaagccatcctcccacctcagcctcctgagcagctgagactacaggtgtgcaccaccacaccccactattttaaaaatattttttgtagagatgaggtctcaccatgttgcccaggctggtcttgaactcctcggctcaagcaatcctccagcctcagcctcccaaagtgctgggattacaggtgtgagccaccacaccgggttttgcctgtgtcctccttatttttgcattcatttatttgtcgctcaatgaacagattcctgcatcttcctcctccccaagagcccccagataccttgacacatctaccccaaccccgcagtgtcagaccagggagaagggacagttgtaaacaagggcatggccagaaggaggcagagaagtcttgctggaggagggaacttttgagctgagttttgaaggacgaataggagttggaccgtgtggaaaacaaacattccaggcaggaggcagggaagggcctgcatgggcaaggctcctggagtgtgagaggaagctgcgagagaaggcaatgggagcagtttgagctgctactttctcctgagggcagtagggagccatagagggagtgagagtgagggcagggctgctaagatcattgtgggaagcgcagtgcagtgcatgctgggtaaataactgggtcctaccccctccactcaccgatgctgaagcgctggggctggctccagacacccctcagccacgctgtgtctgctcgcacctgcaccgtgtaggctacaccagcccgcaggccactgagggtaacttgggtctctgtgggctgcacgggatgctctgcagtgggagaggcaaccctgagtcctgggacctctttactcctcagaggccaggctgggctaccacagcctgtgggtggggtggggattcataggcattttgctaaaatctctactctttctttctttttttttttttttttttgagacggagtcttgctctgtcgcccaggctggagtgtagtggcgccatctcggctcactgcaagctctgcctcctgggttcacaccattctcctgcctcagcctcccgagtagctgagactacaggcgcccgccaccacgcccagctaattttttgtatttgtagtagagacggggtttcactgtgttagccaggatggtctcgatctcctgacctcgtgatctgcccacctcggcctcccaaagtgctgggattacaggtgtgagccaccaagcccaacctaaaatctcttctcttaatgcgcccattcatctcaagattttttttttttttgagatggagtctcactctgttgcccaggctggagtgcagtggcacaatctcagctcactgcaacctccacctcccaggttcaagcgattcttgtgcctcagcctcctgagtagccgggattacaggcgcccaccaccatagccagctaattttttgtatttttaatacacatgaggtttcaccatgttggccaggctggtcttgaactcctggcctcaagtgatccgcccgcctcagcctcccaaagtgctgggattacaggcgtgagccaccgcgtccggctgacttgttggatctttgggcaggtggatctgaggttggaggcaggattggactctggaggcagggcttggacacaggaccaaactgaggactagctaaagcaggtcctgggctttccataagacacgcccaccagtgtgccatgtcagtttaccattaccatggcaacacccggaaattaccgcccctgtccacggcaatgatcccacaacccggaagttactaccttcatcctagatatttctgcataaaccgccccttcatttgcatataattaaaagcgggtataaatatgagacgtagctgccctgcctgtggggcgtccccactctgcaaggagcaggacttctgctgctgctctacacggccacttcagtaaaagtttctgtctaacaccaccgacatgcacttgaactctttcctggggaaagccaaaaaccctcctggctaaaccctgttttgtgggctttcctgtccctcatcagatcccccctccaggccttagtttcctcatctgtggaatggagacagtcatccctgcttgatgagagttcagctgctgctacatgtgaggggcagcttcccatggatgaatccaatacaccataagcacttggctggtgcccacccagccttctccagggtctgcaaggggtgatcgagaccctcaagttcagctgggtgctcatgactaatcccagcactttgggaggccaaggtgggaggatagtttgaggccagaagtttgaaaccagcctgagcgaggccggacacggtggctcacacctgtaatcccagccctttgggaggccaaggcgggtgattcacctgaggtcaagagtttgagaccagcctggtcaacatggtgaaactccgtctctgctaaaaatacaaaaatttgccaggcatggtggtgggtgcctgtaatcccagctacttgggaggctgaggcaagagaattgcctgaacccgggaggcagaggttgcagtgagctgagatggcgccactgcactccagcctgggtgacagagacagactccctctcaaaaagaaaaaaaagaaaaaatcccagcctgggcaatatagcaaggcctcatttctacaaaaaataaaatattaactgtgcatggtggtgtgcacctgtgtttccagctactagggaggctgaggtgggaggatcgcttgagcccaggaggttgaggctgctgtgagctatgatggcaccactgcactccagcctgggcacagagtgagtccctgtctataaaattaaaaaaaaaaaaaaaaagaccctcaagtctaattctcttgtttttgttttttgtttgtttgttttcgtttttgttttttctgagacagagtctcactctgtcacccaggctggagtgcactggtacaatctcggctcactgcaatctccgcctcctgggttcaagcgattctcctgcctcagcctcccgtgtagctagaattacaggcatgtgccaccatgcccggctaattttgtatttttaggagagacggggtttctccaagtttgtcaggctggtcttgaactcctgacctcaggtgatccgcccgccttggcctcccaaagtgctgggattacaggcgtgagccactgcgcccagccaattctcttgttttaagggtttgataaccaaggcccagagaaggacggcaaggtgcccagggtcacacagcaagagagatcacaggccaggatcctcccttcctccccaagccaggtctgcactgcctcacgtacctgacacctgtttgctgtcttcatctcggcagcggacaacatactcctttaggacgccgggacaggtgctcagcagggatggtgcccagtccacagacacagagtccaagctatgattcttcaccgagacgtggtgcggtgtcccagctgctgaggctgcaaccagtaccattgtcatagtcaacaccaagaatgctggtcgaggcctggcacagtggctcgcacctgtaatcccagcactttgggaggccgaggtgggtaagtcatttgaggccaggagttcaagaccagcctggccaacatggcaaaaccccttctctactaaaaatacaaaaattagccaggcatggtggcggacacctgtaatcccagctactcaggaggctgaggcaggagaatcacttgagcccaggaggcagaggttgcagtgagccaagatggcaccactgcactccagcctgggcaacagagcaagaccctgtctttaaaaaaaaaaaaaagcccagccacgatggctcatgcctgcaatcccagcatattgggaggccaaggtgggtagatcacttaaggtcaggagttcgagactagcctgaggaacatggggaaaccctgtttctactaaaactacaaaaattagccaggcatgatggtgggcgcctgtaatcccagctactcggcaggctgaggcacgagaatcgcttgaacccgggatgcagaggtttcagtgagccaagatcgtgccactgcactccagcctgggccacagagagtgactctgtctcaagaaaaaaaaaaaaaaaaaaaaaaaaggagtgctggttgagcacttcctgaatgcccagcctcccactgtccagagacggaggtaacattggccacagagtcaggtgagctgggttttaattctggttctgccactcagtcactgtcatttcccttccctgggcctcagttttcttatctataaaatggacaatgctggccgggcgcagtggctcacacctgtaatcccggcactttgggaggccaaggcaggtggatcacgaggttaggcatttgagaccagcctggccaacatgctaaaaccctgtctctactaaagatacaaaaaattatccaggcatggtagtgcacacctataatcccagctactcaggaggctgaggaaggagaatggcttgaacccgggaggcagaggttgtatgattgcagtggtgcaatcatagctcactgcagcctcaaactcctgggatcaagtgatcttaccacctcagcctcctgagtagttgggactacaggcacatgccaccatggctggcaaacttttttctttctgtagagacggggtcttgctatgttgcccaggctgttcttgaactcctgggttcaagtgatccacaagcctcagcctcccaaagtgccaaagtgctgggattacaggggtgagccattctgtctgccttaacagcattgtccttttttttttttttttttttttttttgagacagagtcttgctctgtcacccagactggagtacagtggcatgatctcagctcactgcaacctccgcctcctgggttcaagcgattctcctgcctcagcctcccaagtatctggaattacaggcacccgccaccacacccggctaatttttgtatttttagtagagacagggtttcgccacattggccaggctggtttcaaactcctgacctcaggtgatccacccaccttggcctcccaaagtgctgggattacatgcgtgagtcactgtgcccagcctctatttttttaaattatttaaaaagaaaaaataatgtaaacctgcaggtttgggtcacttaccattgcccccaaagtggtaggtggacaggaccgtagaccacaaggtgagcttctcggggtgcgcagaggcaaagatggtaatgtagtaacacttttcctgccccattgccccagactctcgactccagctgtaggttgctggaaggataagcaaaggccaggccattcagtagattgtgttcccacctctgcacctttgcactggctgtgccatctgccaggaacccccagaaaactcctactcatgtttcaaagcccttgcaccaatatcccctcctccaagatctcttccctatgcaacacccccaaccccatccccatccccctctaacccagcccttactccatggaaccagggcttcttttttttttttttttgagatggagtctcgctgtgtcacccaggctggagtgcaatagcgcaatcttgactcactgcaatccctgcctcccgggttcaagcgattctcctgtctcagcctcctgagtagctgggatttacaggtgcacaccatcatgcctggctaatttttatatttttagtagagacagggtttctccatgttggccaggctggtctcgaactcctgacctctgttgatccacctgcctcagcctcccaaagtgctgggattacaggtgttagccaccttgcccggacaatggggtcaggggttccgtgtccagttctgtctcctcaggctgtgtattcttcaaggaacaggctgaggctgaggctttctggggctctggcaaggcccagagcaggaagcgggagagtgagaggccacctgagcctcacggcccccctttccctaaagactgctcattaatttgccaccagcatctcgcgaactgccaccttccctggcgcggttgaatatttaacaaacaccttgggatgtgagattcattacctgtatgtgtgtgatctgcctggaactgagctcaggatgccagcaagaggttccagacccatatgggtgagaggctccgaacctcaccctgtccctacctctgtatgacattgagtaagcagcaacacctctctgggccttagacacccgctgtgtgccttccctgcaggtttgaacccaccaggacctaaaagggagggcacagaggaggggtaggcgcaggccattccaggccattacccattccagccggatccgggtcttgcggcgcagtcaggctgcaggtggcaaggcccccgtcctggcccacaggctgccattcaatgcaatacgtcatgctctgagcccgggctggccaatacatggtggtcccgttggttccgacgctgatattcagagccactggttctggaaggagaggggagagacgcatcgagacagttgccatctctctccccagtccccttctctggctcctgcagcctctctcccaccctctcgtctatacccctgaccctacagggccaggggtgtctgtgtttggctgtttccctgcactggaggctgccttggggccaggcacaaagtgggtagcagatggcgtttgtttttttttgttttttctttggagacggattcttgctctgtcgcccaggctggagtgcagtggcatgatctcggctccctgcaacctcagcctcccgggttcaaatgagtctcctgcctcagcctcctgagtagctgggaccacaggcatgcgccaccatttcctggctaatttattattattttttggtggagatggggtttcaccgtgttgcccaggctggtctcgaactcctgacctccagtgatccacctgccttggcttcccaaagtgctgggattacaggcataatccgccgcatccagtcagcaggtggtgtttgaatgagctgagtcctcctccagcctaactgctgtctccttgccaggatattcaccatgagagcttcctgtactgccattacacccacttccagccttgtaggcgtctccggctgtggcagatacctggctgcccaccacttgcctagcctaggcggagagtgtgatgcaagactaggcctccctggcctgaccggcgccactggtggtctcatgccaaactcagaagcacgagcacacacccactcagtccctgggcaaatctctcccactccctcccgccagggcgtcttcatgaatgtcagagagatggatactgcttgcaattctggggatagcaacagccgtttattgagtaccaactgcatgtgccaagccaatgctgagagctttacaggcaccatttcactatgatatgggaccaggctgggtacggtggctcacgcctgtaatcctagcactttgggaggtggagatgggtggatcacttgagcccaggagttcgagaccagcctgggcaacgtagagagacacctgtctctacaaaaaataaaaataaaaaattaaccaggtgtggtggtgcatgtctgtagtcccagctactccagaggctgaggtggaaggatcacttgagtctgggagttcaaggctgcagtgagccatgattgcactccagtctgccaacagactgagaacctagctcaaaaataataaaaatagtaggtcggccacagtggctcacacctgtaatcccagcactttgagaggctgaggtgggtggatcacctgagggcaggagtttgagaccagcctgggcaacatggtgaaactccatctctactaaaaatacaaaaattaggctgggcatggtggctcacgcctataatcccaacactttgggaggccaaggcaggtggatcacttgaggtcaggagttcgagaccagcctggccaacgtggtgaaaccccgtctctactaaaaatacaaaattagccgggtatggtggcagatgcctgtaatcccagctactcgggaggctgaagcaggagaatctcttgaatctggaaggcggaggttgcagtgagctgagatcatgccatctgtcacaagaaaaaaaagaaattagatcttaaataaacacagggtcaactctagccttttttctttctttctctcttttttcttttttgaaaaagagtgtagctctatcaaccagggtggagcgcagtggctcagctagtttttgttgttgttctttaataatgcataatagccaggtatgatggcacatgcctatattcccagctatttgggaggctgagggagaaagattgcttgagcccagaagttcaagtccagcctgggcaacatagcaaaactctgtctcttaaaaaaaacaaaccaacaacaacaaaaaactgcattatggatcttgattattgaattttttttttttgacacagtcttgctctttgttgcccaggctggagtgcaatggcacaattttggctcactgcaacctctggctcctgggttcaagcgattctcctgcctcagcctcccaagtagctgggactacagccaccacactcagctaatttttgtatttttagtagagactgggtttcaccacgttggccagactggtctcgaactgctgacctcaggtgattcacctgtcttagcctcccaaagtgctgggattacaggtgtgagccaccgtgcctggctgattactgaatttttgatacacccctaaatcaggcactcctttaaaattttctgcctcgctcctctcaccctggtctagctgaggctcagagtaggtgctcagctctgaggggccctcataccgccctccccacccagaggaggcacctgtgtgggtgtcggcaggaatgtgccacgtctggttcaggccaggaccaaattggttcgaggagatgacagccacgttgtaggcagcacccgagagatagggcatcttccccaggtgcagggtcctggtggccttggccttacacgggcaggacagcatgtggagctgtagtcggtaagtgacctccgtgccaggcgccagcccttgacagccttctggaagctccagctgggttggctgtcaggagtatgaaagacagcttgtgggtacctgatcacactcatcatcccataggcagacagcagggcacagcctatgaagacagacttggacaaaggccacagccaataacatgcatcaaaaattaaaagaataataaacctcaatgctggcaaagctgctgtgagacaggcattcacctcccgcacacatctagcttgagggaggtgggaaattgacaaaacccactgacattcaggaaaacaaaaatgtttccatcttttaacccagttacctcaagcagaaaatttttccttagaaaaggaatttgagaggccgggcacgggggctcacgcctctaatcccagcactttgggaggccgagacgggtagatcatgaggtcaggagattgagaccatcctggctaacacggtgaaaccccgtctctactaaaaatacaaaaaattagcccggcatggtggtgggcgcctgtagtcccagctactcgggaggctgaggcaggagaatggcgtgaacccgggaggcggagcttgtagtgagccgagatggcgccactgcactccagcctgggcgacagagcaagactccatctcaaaaaaaaaaaaaaaaaaaggaaaaaaaagaagaggaatttgagttagaggaacataggaaataaaggatttttgctacagccttatagtaacagcccattagggacctgactaagatgactatggtaaagtcaacgagtggagtatttgtcagttttgtctcaacagagatactccctctatgcctcagtttccctctctgtaaactaatcagactgcacttaatgggttgttttgggacttaaagcaataatctgctacccaggcaaatgcagtcaccattatctccttcctggccttctggcttctgtgcaattcccccacactctgtttctcacacaggagccagggaaagtctgtgaacatctgagtccagtcatgtgcctctcctgctcacacacacactccatggctccctattaccttcagagttaaacccacaatttgcccacttcctgccacctctacatctcatctccctccatctaccacttgctcatcccccgcctaggcttttgcctcctgctccccatcccaggccaccccacagccctgtgacagccccgttacctgctctttcagggtcagccgcctcctcccatcctggcccagctgctccaccgagaatctcacctgaggctgtggggggttttctgcaatcagaaccaaaccaactagacgaattggaaggagagaaagactgatggatgttttctttgtaaatgatggattctccacatttacaaagtgaaaatcccttgctgccccaaattgcagaaaagagaaaaaactgaaggaagaaaaattaacacaatttgcatccccagggataactgccacctgtaatctcatgttgcctaaggttttttgtttgtttgtttgttcgtttgctttttgagacgaagtctcactctattacctaggctggagtgcactggtgcgatctcggctcactgcaatctctgccttctgggttcaagcgattctcctgcctcagccttccaagtagctgggattacaggcatgcaccaccatgtccggctaatttttgtatttttagtagagacggggtttcaccatgttggtcaggctgttcttgaactcctgaccttgtgatccacttgcctcggcctcccaaactgctggaattataggcgtgagccactgcgcctggcctctaagttcctttttgaatgcaaatgtatttctctgcatggttttgttgttgttgctgttgttttatagactagagacagagtctcgttttgattcccaggcttgtctcaaactcctggcctcaaacaatcctctggcctcggcctcccaaagtgctgggattacaggcataaaccacagcgccaggcctttctgcatggtttgaaaccctctcactcattttcctgttgcccaggctcagggcagcagctgtttagtacaccctgccacctgcaggtgacattgtccttgagacaccgtgaggttcagcctgatgattctcacttgataaagccctgtagtgggctgagcgcagtggctcatacctggaattctagcactttgggagaccgtggtgggaggatcacttgaggccaggagttcgagaccagccgggcaaacatggcgaaaccccatctctactaaaaatacaaaattagctgggcgtggtggtgcatgcctgtaaatcccagctactctggaggctgaggcaggagaatcgcttgaacccgtgaggcggaggttgcagtgagccaagatcacaccactgcactccagccagggtgacagagcaagacagtctcaaaacaaaacaaaaaatagcagtaggccgggcgcggtggctcacgcctgtaatcccagcactttgggaggccgaggagggcagatcacgaggtcaggagattgagaccatcctggctaacatggtgaaaccccgtctctactaaaaaatacaaaaaattaaccgggcgtggttgcagacacctgtagtcccagctacttgggaggctgaggcaggacaatggcgtgaacccgggaggcggagcttgcagtgagccgagatggcgccactgcactccagcctgggtgacagagtgagactccgtctcaaaaaaaaaaacaacaaaaaacaacaaacaaacaaacaaaaaaaacagcagcaaaaaaccctaaagtgggtgcagcaagaccggatgccacattgtcagggtttgagcacccatttctccctctgccttatttctaacactcaccaccttgtttctaatacctgctgccttatttctttttccattttattttattattacttttttttttttttttacttttttttgagacagagtctggccctgtcacccaggctggagtgcagtggtgtgatcttggatccctgcaacctccacctcccgggttcaagggattctcctgcctcagcctcccaagtagctgggattacaggctcccgccaccacgcccagctaattttcgtatttttagtagagaaggggtttcaccatgttggccaggctggtctcgaactcctgacctcaagtgatctgcccgcctcagcctcccaaagtgctgggattacaggcatcagccaccacgcccagccccattttattttattttttagagatggggtctcactatgttgcccgggctggtctcaaaccactggcctcaagtgatcctcccgcctcagccttctgagcagctggaactacaggtgtgcaccaccacctccggctgttgccttatttctaatgcttgcccctgttcctgtactcagagtgatcttaccagggggaacgcacacggggctgctccacttgctccaggaacttccttggctccccagctgccgtcgtcggagctggaattcctgggccacattcatctccagggggcagaggcaggactctggggagaggcaggtcgaacatcaggccgtaagaattgtccaggacttggcaccagtcacttaaccatcatgtgcttattgagctccaactgtgtacagagccacgtgctgggtcctgggggctcagcagaagcaggccaggccctgtcctcttagggcctccaggatcacccacgtccatccctgcccctcagttcaagtcctggctgcggccatcccttcggtcgtgaccttggccaaaggcttctcaccccctccaagtcgtgatttgtttccccacctgcaatttggaaagaatccaatactgaactatggggcagggtaagaggcatacaaaaaaattcagcattggacctggcatacagtaggtgctcaattaatgccaatttgctgcagctgttgttgtcattactattattattctcaccagtatcatcatcctgaggtccgcagtcgccctagaataaaaacatattcatatattgttttgcattttggtgctgaaaaatatttgctgttttacaattagttatttatttacttatttatctgagacacggtctcactctgtcatctaggctggagtgcagtggtgcaatcatggcttattgaagcctcaacctcccagggctcaggtgatcctcccgcctcagtctcctgagtagttgggactacaggcatgcaccatcacactcagctaatttttgcatttttggtagagacgggatttcaccatgttgcccaggctggtctcaaactcctggcctcaagcaatcccaccccaactcggcctcccaaagcactgggattacaggcgtgagccaccgcacctcgctaaatttttttaaattaaagaccatacttccagggattatttctatcgttaattactagagaaccttctctaggttcaaaccttctttaggaacatataaagcagtaaaaaattattataactaaattttaaaaattaataattattttactaaacacaatgtgggatcctggattgaatctgggagcagaaaaaagacattcctggaaaaattggtgacattcaaataatgcctggagtttatgtaagacattaacattagaggagtttgggtaaaggatatatgggcgttctctgcaccagtttatatagtaacttttctgaaaatcgaaggttattccaaaagaaaaaatttattttaaaaaattttagtgggagcaaggcgtggtggttcatgcctgtattcccagcactttggaaggccaaggtgggcggatcacctgaggagtttgagaccagcctggcccacatggcgaaaccccgtctctactaaaaatacaaaaattagctgcgtgtggtagtgggcgcatgcctgtaatcccagctactcgggaggctgacgcaggacaatcgcttgaacccgggaggcagaggttgcagtgagctgagatcatgccactgcactccagcctgggcgacagagcaaggctccgtctcagaaaaaaaaaaagaaaaagaaaaaaaccacctcaggggctagagtgggggctggttgggagcggggacagatgcagagatggtgagactgatttgggggtgaaggtgccctggagaggcccgtgtccaccctggacttgggaaacaaactcaccaacttccatgggctgctgggtgtccggtgccggaactgcacctcagcaccaacctggttatccggggtctcccactccatacgcagctgcccggccaacttggacaccttgatgtctcccagaggaggctcatatttaactggaagcagaggtagggattggcgaggggcagcccacacgtatgtgagttaatgggccctgaaaatccaccctgtccagggtaagcaactgaatccctaaatatgaattaggggacacttgcaggtcccagctaagcctggtatattatgatcaaaaagtcaagatttatacacaagccacatacggtggctcaccctgtaattccagtattttgggaggccaaggcaggaagatcacttaagcccaggagttcgagaccagcctgggcaacatagtgagaccccctcatctctacataaaaattagccaggcatggtagttcatgactgtggttccagctacttaggagagtgagatgggaggatctcttgagcctaggaggctgaggctgaagtgagccctgatcacaccactgctctccaatctaggagagagagggagaacttgtctctaaaaaaacaacaaatatggccaggagcagtggctcatagctgtaatcctagcactttgggaagccaaggtgggtggatcatctgaggtcaggagtttaagaccaacctggccaacacggtgaaacaccgtctctactaaatacaaaaattagccaggcatggtggtgggcacctgtaatcccagctacttgggagcctgaggcaggagaatcgcttgaacccaggaggcggaggttgtagttagacaagatcccaccactgccctccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccacctcgggctcccaaagtgctgggattataggcatgagccactgtgtccagccaattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccatggccaggcacaggggcccacgcctgtactcgaagcactttgggaggccaagacaggaggatcatttgagcccaggagttcaagaccaccctggccaacacagcaagaccccatctcttaaaaatatatatacatatccatcaccttctataattacttttttggtgtgtggtgagaacacttaaaatttttttttttttttttgagatggagtctcgctctgtcacccaggctggagtgcagtggtgtgatctcggttcactgtaacctccataccacaggttcacgtgattctcctgcctcagcatcccgagtagctggaattacaggcgcccgccaccacactcggctaatttttgtatttttagtagagatggggtttcaccatgttggtcaggctggtctcgaactcctgacctcaggtgatcctcccacctcggcctctcgaagtgctaggattacaggcgtgaaccactgcacccagcccttaaatctattcttttagcaaattttcaatatacattatttttaattatagttctctactgtaccttggaactctagatttatttgtgctgcgtaactacaaattgtattcctttgacctacatctcccccatttcctccttctctccatccccggtaaccacagttctactttcggtgcctagatattcgactttttttttttaagattatacatgtaagtgggatgggcgcggtggctcacgcctgtaatcccagcactttgggaggctgaggcgggtggatcatgaggtcaggagatcgagaccacggtgaaaccccgtctctactaaaaatacaaaaacttagccgggcgcggtggcgggcgcctgtagtcccagctactggggaggctgaggcaggagaatggtgtgaacccaggaggcagagcttgcagtgagccgagatcgcgccactgcactccagcctgggcgacagagcgaaactccatctcaaaaaaaagaaaaaagaaaaaaagattatacatgtaagtgagatcatgaaatgtttttgtttctgtgcctggcttacttcactcagcgtaatgtcctccagctttgtccatgttgtggcaaatgacatgttttccttcattcttttcttttcttttttcttttttttctttttttttgagacagtgtcttgctctgtcactcaggctggaatgcagtgacttgatcttagctcactgcaacatctgcctcctggattcaagccattctcccgcctcagcctcctgggtagctgggattgcaggcatgcaccaccacaccaggcaaatttttttggcttttttgtgtgttgctgttgttttttagatggagtcctgctctgtcgccaggcaggagtgcagtggctcaatctcagctcactgtaacctccacctcccgggttcaagcgattctcctgcctcagtctccccagtagctgggactacaggcgcgcgtggccactcctggctaatttttgtatttttaatagagatggggtttcaccatgttgaccaggatggtctcgatctcttgaccttgtgatccacccacctcagcctcccaaagtgctgggattacaggcgtgatccaccgcacccggcaaaatacatgatgtcgagtcatgagaacagataataagaacccaaccaggtcttggcagcattatggctagcagagagaaaccagaagcaatctaagtgcccacgaataggggattggtaaggggaccatgaaagactgctttgtcacaatagtgtttgcgtgacactacgtgaagtgacaatggctagtagtatcaagtcccttgccaagggccaggaatcctctctagctccagccttgcagcctgatggcctctctgggtaaaaaacggacggggggagaacaaggtgctaacctgagttgtagagctgcagggtcacctcaggagacttctctgtctggttcctggcccaggattccacccagagtgtgacagtgtacagcacagacaccccagcctggtcggagaactgcagcctggtggctgagccggcggcgaagtagcagcagcgcccggagctaaggctgcagcaggaaggagggtgtcagtgccgagtctggggtcctagtggaccccacagccgactttgtgcatcacatcccagcatcgtttttttggtgtttgtttgtttgtttggagatggagtttcattctgtcacccaggctggagtgcagtcgcgcaatctcggctcactgcaacctccacctccctggttcaagcaattctcccacctcagcctccctagtagctgggattacaggcacatgccaccacatgcgtctaagttttgtatttttagtagagatggagtttcaccatgttggccaggctggtctccaacttctggcctcaagtgatccgcccacctcagcctcccaaagtgctgggattacaagcgtgagccaccgtgcccagcccccagcatccttttctgtcccttgtacacctcctcccccagcctgggggttccttggagatcagtctgggactggaggggtttgagggaccccagtatctcccagcaaggactgcaccacacagcgaagaaacgaatgaaagggctgggcgcagtgcctcacgcttgtaatcccagcactttgggaggccaagggggggtggatcacctgaggccaggagttcaagaccagcctggccaacatggtgagactctgtctctactaaaaatacaaaaattagcaggtgtggtggcgtgtgcctatagtcccagctactcaggaggctgaggcaggaaaatcactctaactcaggaggcagaggttgcagtgagctgacatcatgccactgcactccagcctgggcaacagagcaagactccatctcaaaaaaagaaaaaaagaaaaaagaaaaaatggatggatggatggatggatggatggatggatggatggttggatgggtggataagtgaaagggtgaagaagaaaaaaggactagagagaccctcatggccacccaccctgggatgcctaccttcactgaccaaccccccaccacaatcctccaactctctcttcttagatgagaaactgaagcccaggaaggagtgttgacccagccaagatcacgcatccgagagtaggggcaccagagggggttgaagcaagagtgggatggtgggtgagggtttgggaatggtagaggggtcctcaccaacaccgcaggaagtggctgaccccagctgtgggaccctcatactgccaggagcactcgtaacgatcactggatatccgatagcatctcaggtccctagggcccgaggccgagcctggaagagatcctgtaggcttgggaacagaccagagtctggaggggtcttcgtgcctaagacaaatctttgtgatgcttacatctttcagcgtcacctcagcctaaaccctccccgcgtccttcctacctcatcccctgccgtctctcacctcaacctattccgaatcctcagcctcctaacttgtcctcacagaggccagatgtcctgccacctctctctctatccctcaccctcctctggtgtttttttttggggggtccccagggccccaactttcctcctctggttcttcaaaacacatcatcacatttgtgatagacatttgtttgcctgttgtctatctcttccactaggctgtggtcttgggaagttagttgagctcatagccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcacggtggctcattcctggaatcccagcactttgggaggctgaggcaggtggctcaccatcacctgagctcaggagttcaagaccagcctgggcgacatggtgaaacctggtctctactaaaaatacaaaaattagccgggtgtggtggcgggcacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctactccagggcaacttgaacctggtaagaatgggccagcaggtggtggggtggggactcccaagaccacaggcagggctgggtctttggcctggtggtggaggccatgggaggggccgctgtggatggggtcaggcagagccctacataatcctcagccaacaatgaggaactgccccgaacctgagtctgcatccggatatggcgggtcctgaaaacagcactcactggttctgcaggcagctgcaaaggcaatgaagacataatgacattcctggccttgcactgtgtggggagaagggctcagccttggggtctacacccaagtgatcatcagccctcccacccacccactttcccatctatgcaccctcctaccaccacccatccatccatctgcccatgtatttatctgcccatctacccatccatccatgtatttattcatccgtccaccatctacccatccatccacccatgaattcatccattcacccatccatccatccatccatccatccatccatccatgtattcatccatcatccatccaccccaccatccacccatctacccatccatccatccatgtactcatccatccatccactcatctacccatccatctatccaaccatccatgtattcattcatccatccacccatctatccatccatccatccacctcaccatccacccattcacccatccatccatgtattcatccatccatgtattcatccatccatgcacccatctacccatccatccatccatccatccatccatccatccaccccaccatccacccatttacccatccatccatgtatttatccatccatgtattcatccatccatccacgcatctacccatccatctatccatccatgtgttcattcatccatctactcatccatccatctgccccaccatccatccatccacgtattcatacatccatccatccaccccaccatccgtccatccatccacgtattcatccatccatccatccaccccccatccatctatccatccatccatccatccatccatccatccatcaatccatgtattaatccatgcatccaccccaccatccacccatttatccgtccattcgtccattcatccatccatccatgtattaatccatccatccatccatccatccatcccaccatccacccattcacccatccatccatgtattcattagtccatccatccatccatccatccatgtatttatccatgcatccatgcattcattaatccattatccattcacccaaccatccatctatccatctagtcaccaatctatccatctatccatccacgtattcattcatccatacacccacccatccatccatttatctacctaccgatatatccatccagccatccatccatccatccatccatccatccatccatccatacatacatacatgtatttattaattcatccatccattcatttacccacccatccacctgtctatccattcatccaccaccctttagtcctcagaggttgagatgcatatttgggagacactctcgggaggtacccctgcaggaaagaacagtaagaccaacagtctggagggcagagagaagtggaggtgtgcctggggtggcaccagtgtctgaagccagcatggggaaagacagtagagggtgcatggcagggagaggcctgccagggctggcccaggcaagcacacttggcccactagcagtcagggcaattattaataacatttctccaggaggcagcgacctccctcagccactgggatccccgtgccctttgggattgccacagtctgctaggtgtggaactgggtgagagaaggagggggatgccaccatggatgggtcaggaagaccccggcgccctcactcccacaagaaggacctgtcctgagccctgcaggcagattggaagccttgggggagaaggcggcaccccaggaaacagccccaagtgtccaaccttgaggggggaaagatgcttaacacacaaggctctccatccttccatctctctctgtgatgacacagaacccccacccacccacccacccctgagagcctaaagcccatcctccttccctttccctggactgaccactcactgccactatctccaggatacctcgtgggctgcctctcgccccctccctgctgctggtctccagccatgcctggcccctgaaggcgctgggaccttgaggtgtggccagcactgctgtgggcattctacaggcactcagtgcatctcaagagccattgaaaaagtcagcaccccgctgatccccagtgtacagagaaggaaagtttatttattattattattattgagatagagtcttgctctgccacacaggctggaatgcagtgctgcaatctcggctcactgcaacctctgcctcctgggttcaagcgatcctcccacctcagctcctaagtagctgggagtacaggtgcccatcatcaagcctggctaatttttgcatttttagtagagatggggtttcaccatgttagccaggctggtctcgaactcctgacctcaagtgatccacccatcttggcctcccatagtgctggattttcaggagtgagtcaccgtgcagggcctgagattattaaaagtatatgggaaggctgggcatggtggctcatgcctgtaatctgagcactttgggaggccaaggtgagtggatcatttgagcccaggagttcgagaccagcctgggcaacacagcgagacgctgtctctgtaaaaagtatacaccaaaaaaattaaccaggcatggtagtgtgcacctgcagtcccagctactcaaggggctaaggcaggaggatcacttgagcccaggtggtcaaggctgcaatgagttatgattaggccactgcactccagcctgggacacagagtgagaccctacctcagtaaataaataaataaataaataaataaataaataaataaataaataagtaaagtatacggaaggatgtgcataggttatatgcaaatactttaccattttatatcaggaacttgagcatctttggattttggtatctgcagagggtcctggaaccattgccccgtaaatatggaaatgactgtatacattatattatgtatgtctatctattgtaaactacatacataagatactatactatgtatacctattagatacatacttgctttttattccttccttagttttttttctcattgaactccgggaggtggaaaaaatttagtgcatttcacagaagagaaaatctagaccagaggaaagatgtctaagttcgatcccagaagccatgactgcccatctcccatttgacagcaggaaagactgaggcacagagagatgaaaccaacccacacagcaggcccacagctctccacacatacacgtgcctccacccagcaagaggagccgccatgccagggtcaggggactcaccgccctgcctggacagcaggaagaggaagaggagggggaccacccaggtcaccagcggctccatcggatccacgtagagccccacagccccaggggagcctctctgccacctgcgaggttcagccacc

SEQ ID NO: 1790 - DNA, 16326 bp, Homo sapiens
  source 1..16326: mol_type = genomic DNA
tggggatagcaacagccgtttattgagtaccaactgcatgtgccaagccaatgctgagagctttacaggcaccatttcactatgatatgggaccaggctgggtacggtggctcacgcctgtaatcctagcactttgggaggtggagatgggtggatcacttgagcccaggagttcgagaccagcctgggcaacgtagagagacacctgtctctacaaaaaataaaaataaaaaattaaccaggtgtggtggtgcatgtctgtagtcccagctactccagaggctgaggtggaaggatcacttgagtctgggagttcaaggctgcagtgagccatgattgcactccagtctgccaacagactgagaacctagctcaaaaataataaaaatagtaggtcggccacagtggctcacacctgtaatcccagcactttgagaggctgaggtgggtggatcacctgagggcaggagtttgagaccagcctgggcaacatggtgaaactccatctctactaaaaatacaaaaattaggctgggcatggtggctcacgcctataatcccaacactttgggaggccaaggcaggtggatcacttgaggtcaggagttcgagaccagcctggccaacgtggtgaaaccccgtctctactaaaaatacaaaattagccgggtatggtggcagatgcctgtaatcccagctactcgggaggctgaagcaggagaatctcttgaatctggaaggcggaggttgcagtgagctgagatcatgccatctgtcacaagaaaaaaaagaaattagatcttaaataaacacagggtcaactctagccttttttctttctttctctcttttttcttttttgaaaaagagtgtagctctatcaaccagggtggagcgcagtggctcagctagtttttgttgttgttctttaataatgcataatagccaggtatgatggcacatgcctatattcccagctatttgggaggctgagggagaaagattgcttgagcccagaagttcaagtccagcctgggcaacatagcaaaactctgtctcttaaaaaaaacaaaccaacaacaacaaaaaactgcattatggatcttgattattgaattttttttttttgacacagtcttgctctttgttgcccaggctggagtgcaatggcacaattttggctcactgcaacctctggctcctgggttcaagcgattctcctgcctcagcctcccaagtagctgggactacagccaccacactcagctaatttttgtatttttagtagagactgggtttcaccacgttggccagactggtctcgaactgctgacctcaggtgattcacctgtcttagcctcccaaagtgctgggattacaggtgtgagccaccgtgcctggctgattactgaatttttgatacacccctaaatcaggcactcctttaaaattttctgcctcgctcctctcaccctggtctagctgaggctcagagtaggtgctcagctctgaggggccctcataccgccctccccacccagaggaggcacctgtgtgggtgtcggcaggaatgtgccacgtctggttcaggccaggaccaaattggttcgaggagatgacagccacgttgtaggcagcacccgagagatagggcatcttccccaggtgcagggtcctggtggccttggccttacacgggcaggacagcatgtggagctgtagtcggtaagtgacctccgtgccaggcgccagcccttgacagccttctggaagctccagctgggttggctgtcaggagtatgaaagacagcttgtgggtacctgatcacactcatcatcccataggcagacagcagggcacagcctatgaagacagacttggacaaaggccacagccaataacatgcatcaaaaattaaaagaataataaacctcaatgctggcaaagctgctgtgagacaggcattcacctcccgcacacatctagcttgagggaggtgggaaattgacaaaacccactgacattcaggaaaacaaaaatgtttccatcttttaacccagttacctcaagcagaaaatttttccttagaaaaggaatttgagaggccgggcacgggggctcacgcctctaatcccagcactttgggaggccgagacgggtagatcatgaggtcaggagattgagaccatcctggctaacacggtgaaaccccgtctctactaaaaatacaaaaaattagcccggcatggtggtgggcgcctgtagtcccagctactcgggaggctgaggcaggagaatggcgtgaacccgggaggcggagcttgtagtgagccgagatggcgccactgcactccagcctgggcgacagagcaagactccatctcaaaaaaaaaaaaaaaaaaaggaaaaaaaagaagaggaatttgagttagaggaacataggaaataaaggatttttgctacagccttatagtaacagcccattagggacctgactaagatgactatggtaaagtcaacgagtggagtatttgtcagttttgtctcaacagagatactccctctatgcctcagtttccctctctgtaaactaatcagactgcacttaatgggttgttttgggacttaaagcaataatctgctacccaggcaaatgcagtcaccattatctccttcctggccttctggcttctgtgcaattcccccacactctgtttctcacacaggagccagggaaagtctgtgaacatctgagtccagtcatgtgcctctcctgctcacacacacactccatggctccctattaccttcagagttaaacccacaatttgcccacttcctgccacctctacatctcatctccctccatctaccacttgctcatcccccgcctaggcttttgcctcctgctccccatcccaggccaccccacagccctgtgacagccccgttacctgctctttcagggtcagccgcctcctcccatcctggcccagctgctccaccgagaatctcacctgaggctgtggggggttttctgcaatcagaaccaaaccaactagacgaattggaaggagagaaagactgatggatgttttctttgtaaatgatggattctccacatttacaaagtgaaaatcccttgctgccccaaattgcagaaaagagaaaaaactgaaggaagaaaaattaacacaatttgcatccccagggataactgccacctgtaatctcatgttgcctaaggttttttgtttgtttgtttgttcgtttgctttttgagacgaagtctcactctattacctaggctggagtgcactggtgcgatctcggctcactgcaatctctgccttctgggttcaagcgattctcctgcctcagccttccaagtagctgggattacaggcatgcaccaccatgtccggctaatttttgtatttttagtagagacggggtttcaccatgttggtcaggctgttcttgaactcctgaccttgtgatccacttgcctcggcctcccaaactgctggaattataggcgtgagccactgcgcctggcctctaagttcctttttgaatgcaaatgtatttctctgcatggttttgttgttgttgctgttgttttatagactagagacagagtctcgttttgattcccaggcttgtctcaaactcctggcctcaaacaatcctctggcctcggcctcccaaagtgctgggattacaggcataaaccacagcgccaggcctttctgcatggtttgaaaccctctcactcattttcctgttgcccaggctcagggcagcagctgtttagtacaccctgccacctgcaggtgacattgtccttgagacaccgtgaggttcagcctgatgattctcacttgataaagccctgtagtgggctgagcgcagtggctcatacctggaattctagcactttgggagaccgtggtgggaggatcacttgaggccaggagttcgagaccagccgggcaaacatggcgaaaccccatctctactaaaaatacaaaattagctgggcgtggtggtgcatgcctgtaaatcccagctactctggaggctgaggcaggagaatcgcttgaacccgtgaggcggaggttgcagtgagccaagatcacaccactgcactccagccagggtgacagagcaagacagtctcaaaacaaaacaaaaaatagcagtaggccgggcgcggtggctcacgcctgtaatcccagcactttgggaggccgaggagggcagatcacgaggtcaggagattgagaccatcctggctaacatggtgaaaccccgtctctactaaaaaatacaaaaaattaaccgggcgtggttgcagacacctgtagtcccagctacttgggaggctgaggcaggacaatggcgtgaacccgggaggcggagcttgcagtgagccgagatggcgccactgcactccagcctgggtgacagagtgagactccgtctcaaaaaaaaaaacaacaaaaaacaacaaacaaacaaacaaaaaaaacagcagcaaaaaaccctaaagtgggtgcagcaagaccggatgccacattgtcagggtttgagcacccatttctccctctgccttatttctaacactcaccaccttgtttctaatacctgctgccttatttctttttccattttattttattattacttttttttttttttttacttttttttgagacagagtctggccctgtcacccaggctggagtgcagtggtgtgatcttggatccctgcaacctccacctcccgggttcaagggattctcctgcctcagcctcccaagtagctgggattacaggctcccgccaccacgcccagctaattttcgtatttttagtagagaaggggtttcaccatgttggccaggctggtctcgaactcctgacctcaagtgatctgcccgcctcagcctcccaaagtgctgggattacaggcatcagccaccacgcccagccccattttattttattttttagagatggggtctcactatgttgcccgggctggtctcaaaccactggcctcaagtgatcctcccgcctcagccttctgagcagctggaactacaggtgtgcaccaccacctccggctgttgccttatttctaatgcttgcccctgttcctgtactcagagtgatcttaccagggggaacgcacacggggctgctccacttgctccaggaacttccttggctccccagctgccgtcgtcggagctggaattcctgggccacattcatctccagggggcagaggcaggactctggggagaggcaggtcgaacatcaggccgtaagaattgtccaggacttggcaccagtcacttaaccatcatgtgcttattgagctccaactgtgtacagagccacgtgctgggtcctgggggctcagcagaagcaggccaggccctgtcctcttagggcctccaggatcacccacgtccatccctgcccctcagttcaagtcctggctgcggccatcccttcggtcgtgaccttggccaaaggcttctcaccccctccaagtcgtgatttgtttccccacctgcaatttggaaagaatccaatactgaactatggggcagggtaagaggcatacaaaaaaattcagcattggacctggcatacagtaggtgctcaattaatgccaatttgctgcagctgttgttgtcattactattattattctcaccagtatcatcatcctgaggtccgcagtcgccctagaataaaaacatattcatatattgttttgcattttggtgctgaaaaatatttgctgttttacaattagttatttatttacttatttatctgagacacggtctcactctgtcatctaggctggagtgcagtggtgcaatcatggcttattgaagcctcaacctcccagggctcaggtgatcctcccgcctcagtctcctgagtagttgggactacaggcatgcaccatcacactcagctaatttttgcatttttggtagagacgggatttcaccatgttgcccaggctggtctcaaactcctggcctcaagcaatcccaccccaactcggcctcccaaagcactgggattacaggcgtgagccaccgcacctcgctaaatttttttaaattaaagaccatacttccagggattatttctatcgttaattactagagaaccttctctaggttcaaaccttctttaggaacatataaagcagtaaaaaattattataactaaattttaaaaattaataattattttactaaacacaatgtgggatcctggattgaatctgggagcagaaaaaagacattcctggaaaaattggtgacattcaaataatgcctggagtttatgtaagacattaacattagaggagtttgggtaaaggatatatgggcgttctctgcaccagtttatatagtaacttttctgaaaatcgaaggttattccaaaagaaaaaatttattttaaaaaattttagtgggagcaaggcgtggtggttcatgcctgtattcccagcactttggaaggccaaggtgggcggatcacctgaggagtttgagaccagcctggcccacatggcgaaaccccgtctctactaaaaatacaaaaattagctgcgtgtggtagtgggcgcatgcctgtaatcccagctactcgggaggctgacgcaggacaatcgcttgaacccgggaggcagaggttgcagtgagctgagatcatgccactgcactccagcctgggcgacagagcaaggctccgtctcagaaaaaaaaaaagaaaaagaaaaaaaccacctcaggggctagagtgggggctggttgggagcggggacagatgcagagatggtgagactgatttgggggtgaaggtgccctggagaggcccgtgtccaccctggacttgggaaacaaactcaccaacttccatgggctgctgggtgtccggtgccggaactgcacctcagcaccaacctggttatccggggtctcccactccatacgcagctgcccggccaacttggacaccttgatgtctcccagaggaggctcatatttaactggaagcagaggtagggattggcgaggggcagcccacacgtatgtgagttaatgggccctgaaaatccaccctgtccagggtaagcaactgaatccctaaatatgaattaggggacacttgcaggtcccagctaagcctggtatattatgatcaaaaagtcaagatttatacacaagccacatacggtggctcaccctgtaattccagtattttgggaggccaaggcaggaagatcacttaagcccaggagttcgagaccagcctgggcaacatagtgagaccccctcatctctacataaaaattagccaggcatggtagttcatgactgtggttccagctacttaggagagtgagatgggaggatctcttgagcctaggaggctgaggctgaagtgagccctgatcacaccactgctctccaatctaggagagagagggagaacttgtctctaaaaaaacaacaaatatggccaggagcagtggctcatagctgtaatcctagcactttgggaagccaaggtgggtggatcatctgaggtcaggagtttaagaccaacctggccaacacggtgaaacaccgtctctactaaatacaaaaattagccaggcatggtggtgggcacctgtaatcccagctacttgggagcctgaggcaggagaatcgcttgaacccaggaggcggaggttgtagttagacaagatcccaccactgccctccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccacctcgggctcccaaagtgctgggattataggcatgagccactgtgtccagccaattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccatggccaggcacaggggcccacgcctgtactcgaagcactttgggaggccaagacaggaggatcatttgagcccaggagttcaagaccaccctggccaacacagcaagaccccatctcttaaaaatatatatacatatccatcaccttctataattacttttttggtgtgtggtgagaacacttaaaatttttttttttttttttgagatggagtctcgctctgtcacccaggctggagtgcagtggtgtgatctcggttcactgtaacctccataccacaggttcacgtgattctcctgcctcagcatcccgagtagctggaattacaggcgcccgccaccacactcggctaatttttgtatttttagtagagatggggtttcaccatgttggtcaggctggtctcgaactcctgacctcaggtgatcctcccacctcggcctctcgaagtgctaggattacaggcgtgaaccactgcacccagcccttaaatctattcttttagcaaattttcaatatacattatttttaattatagttctctactgtaccttggaactctagatttatttgtgctgcgtaactacaaattgtattcctttgacctacatctcccccatttcctccttctctccatccccggtaaccacagttctactttcggtgcctagatattcgactttttttttttaagattatacatgtaagtgggatgggcgcggtggctcacgcctgtaatcccagcactttgggaggctgaggcgggtggatcatgaggtcaggagatcgagaccacggtgaaaccccgtctctactaaaaatacaaaaacttagccgggcgcggtggcgggcgcctgtagtcccagctactggggaggctgaggcaggagaatggtgtgaacccaggaggcagagcttgcagtgagccgagatcgcgccactgcactccagcctgggcgacagagcgaaactccatctcaaaaaaaagaaaaaagaaaaaaagattatacatgtaagtgagatcatgaaatgtttttgtttctgtgcctggcttacttcactcagcgtaatgtcctccagctttgtccatgttgtggcaaatgacatgttttccttcattcttttcttttcttttttcttttttttctttttttttgagacagtgtcttgctctgtcactcaggctggaatgcagtgacttgatcttagctcactgcaacatctgcctcctggattcaagccattctcccgcctcagcctcctgggtagctgggattgcaggcatgcaccaccacaccaggcaaatttttttggcttttttgtgtgttgctgttgttttttagatggagtcctgctctgtcgccaggcaggagtgcagtggctcaatctcagctcactgtaacctccacctcccgggttcaagcgattctcctgcctcagtctccccagtagctgggactacaggcgcgcgtggccactcctggctaatttttgtatttttaatagagatggggtttcaccatgttgaccaggatggtctcgatctcttgaccttgtgatccacccacctcagcctcccaaagtgctgggattacaggcgtgatccaccgcacccggcaaaatacatgatgtcgagtcatgagaacagataataagaacccaaccaggtcttggcagcattatggctagcagagagaaaccagaagcaatctaagtgcccacgaataggggattggtaaggggaccatgaaagactgctttgtcacaatagtgtttgcgtgacactacgtgaagtgacaatggctagtagtatcaagtcccttgccaagggccaggaatcctctctagctccagccttgcagcctgatggcctctctgggtaaaaaacggacggggggagaacaaggtgctaacctgagttgtagagctgcagggtcacctcaggagacttctctgtctggttcctggcccaggattccacccagagtgtgacagtgtacagcacagacaccccagcctggtcggagaactgcagcctggtggctgagccggcggcgaagtagcagcagcgcccggagctaaggctgcagcaggaaggagggtgtcagtgccgagtctggggtcctagtggaccccacagccgactttgtgcatcacatcccagcatcgtttttttggtgtttgtttgtttgtttggagatggagtttcattctgtcacccaggctggagtgcagtcgcgcaatctcggctcactgcaacctccacctccctggttcaagcaattctcccacctcagcctccctagtagctgggattacaggcacatgccaccacatgcgtctaagttttgtatttttagtagagatggagtttcaccatgttggccaggctggtctccaacttctggcctcaagtgatccgcccacctcagcctcccaaagtgctgggattacaagcgtgagccaccgtgcccagcccccagcatccttttctgtcccttgtacacctcctcccccagcctgggggttccttggagatcagtctgggactggaggggtttgagggaccccagtatctcccagcaaggactgcaccacacagcgaagaaacgaatgaaagggctgggcgcagtgcctcacgcttgtaatcccagcactttgggaggccaagggggggtggatcacctgaggccaggagttcaagaccagcctggccaacatggtgagactctgtctctactaaaaatacaaaaattagcaggtgtggtggcgtgtgcctatagtcccagctactcaggaggctgaggcaggaaaatcactctaactcaggaggcagaggttgcagtgagctgacatcatgccactgcactccagcctgggcaacagagcaagactccatctcaaaaaaagaaaaaaagaaaaaagaaaaaatggatggatggatggatggatggatggatggatggatggttggatgggtggataagtgaaagggtgaagaagaaaaaaggactagagagaccctcatggccacccaccctgggatgcctaccttcactgaccaaccccccaccacaatcctccaactctctcttcttagatgagaaactgaagcccaggaaggagtgttgacccagccaagatcacgcatccgagagtaggggcaccagagggggttgaagcaagagtgggatggtgggtgagggtttgggaatggtagaggggtcctcaccaacaccgcaggaagtggctgaccccagctgtgggaccctcatactgccaggagcactcgtaacgatcactggatatccgatagcatctcaggtccctagggcccgaggccgagcctggaagagatcctgtaggcttgggaacagaccagagtctggaggggtcttcgtgcctaagacaaatctttgtgatgcttacatctttcagcgtcacctcagcctaaaccctccccgcgtccttcctacctcatcccctgccgtctctcacctcaacctattccgaatcctcagcctcctaacttgtcctcacagaggccagatgtcctgccacctctctctctatccctcaccctcctctggtgtttttttttggggggtccccagggccccaactttcctcctctggttcttcaaaacacatcatcacatttgtgatagacatttgtttgcctgttgtctatctcttccactaggctgtggtcttgggaagttagttgagctcatagccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcacggtggctcattcctggaatcccagcactttgggaggctgaggcaggtggctcaccatcacctgagctcaggagttcaagaccagcctgggcgacatggtgaaacctggtctctactaaaaatacaaaaattagccgggtgtggtggcgggcacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctactccagggcaacttgaacctggtaagaatgggccagcaggtggtggggtggggactcccaagaccacaggcagggctgggtctttggcctggtggtggaggccatgggaggggccgctgtggatggggtcaggcagagccctacataatcctcagccaacaatgaggaactgccccgaacctgagtctgcatccggatatggcgggtcctgaaaacagcactcactggttctgcaggcagctgcaaaggcaatgaagacataatgacattcctggccttgcactgtgtggggagaagggctcagccttggggtctacacccaagtgatcatcagccctcccacccacccactttcccatctatgcaccctcctaccaccacccatccatccatctgcccatgtatttatctgcccatctacccatccatccatgtatttattcatccgtccaccatctacccatccatccacccatgaattcatccattcacccatccatccatccatccatccatccatccatccatgtattcatccatcatccatccaccccaccatccacccatctacccatccatccatccatgtactcatccatccatccactcatctacccatccatctatccaaccatccatgtattcattcatccatccacccatctatccatccatccatccacctcaccatccacccattcacccatccatccatgtattcatccatccatgtattcatccatccatgcacccatctacccatccatccatccatccatccatccatccatccaccccaccatccacccatttacccatccatccatgtatttatccatccatgtattcatccatccatccacgcatctacccatccatctatccatccatgtgttcattcatccatctactcatccatccatctgccccaccatccatccatccacgtattcatacatccatccatccaccccaccatccgtccatccatccacgtattcatccatccatccatccaccccccatccatctatccatccatccatccatccatccatccatccatcaatccatgtattaatccatgcatccaccccaccatccacccatttatccgtccattcgtccattcatccatccatccatgtattaatccatccatccatccatccatccatcccaccatccacccattcacccatccatccatgtattcattagtccatccatccatccatccatccatgtatttatccatgcatccatgcattcattaatccattatccattcacccaaccatccatctatccatctagtcaccaatctatccatctatccatccacgtattcattcatccatacacccacccatccatccatttatctacctaccgatatatccatccagccatccatccatccatccatccatccatccatccatccatacatacatacatgtatttattaattcatccatccattcatttacccacccatccacctgtctatccattcatccaccaccctttagtcctcagaggttgagatgcatatttgggagacactctcgggaggtacccctgcaggaaagaacagtaagaccaacagtctggagggcagagagaagtggaggtgtgcctggggtggcaccagtgtctgaagccagcatggggaaagacagtagagggtgcatggcagggagaggcctgccagggctggcccaggcaagcacacttggcccactagcagtcagggcaattattaataacatttctccaggaggcagcgacctccctcagccactgggatccccgtgccctttgggattgccacagtctgctaggtgtggaactgggtgagagaaggagggggatgccaccatggatgggtcaggaagaccccggcgccctcactcccacaagaaggacctgtcctgagccctgcaggcagattggaagccttgggggagaaggcggcaccccaggaaacagccccaagtgtccaaccttgaggggggaaagatgcttaacacacaaggctctccatccttccatctctctctgtgatgacacagaacccccacccacccacccacccctgagagcctaaagcccatcctccttccctttccctggactgaccactcactgccactatctccaggatacctcgtgggctgcctctcgccccctccctgctgctggtctccagccatgcctggcccctgaaggcgctgggaccttgaggtgtggccagcactgctgtgggcattctacaggcactcagtgcatctcaagagccattgaaaaagtcagcaccccgctgatccccagtgtacagagaaggaaagtttatttattattattattattgagatagagtcttgctctgccacacaggctggaatgcagtgctgcaatctcggctcactgcaacctctgcctcctgggttcaagcgatcctcccacctcagctcctaagtagctgggagtacaggtgcccatcatcaagcctggctaatttttgcatttttagtagagatggggtttcaccatgttagccaggctggtctcgaactcctgacctcaagtgatccacccatcttggcctcccatagtgctggattttcaggagtgagtcaccgtgcagggcctgagattattaaaagtatatgggaaggctgggcatggtggctcatgcctgtaatctgagcactttgggaggccaaggtgagtggatcatttgagcccaggagttcgagaccagcctgggcaacacagcgagacgctgtctctgtaaaaagtatacaccaaaaaaattaaccaggcatggtagtgtgcacctgcagtcccagctactcaaggggctaaggcaggaggatcacttgagcccaggtggtcaaggctgcaatgagttatgattaggccactgcactccagcctgggacacagagtgagaccctacctcagtaaataaataaataaataaataaataaataaataaataaataaataagtaaagtatacggaaggatgtgcataggttatatgcaaatactttaccattttatatcaggaacttgagcatctttggattttggtatctgcagagggtcctggaaccattgccccgtaaatatggaaatgactgtatacattatattatgtatgtctatctattgtaaactacatacataagatactatactatgtatacctattagatacatacttgctttttattccttccttagttttttttctcattgaactccgggaggtggaaaaaatttagtgcatttcacagaagagaaaatctagaccagaggaaagatgtctaagttcgatcccagaagccatgactgcccatctcccatttgacagcaggaaagactgaggcacagagagatgaaaccaacccacacagcaggcccacagctctccacacatacacgtgcctccacccagcaagaggagccgccatgccagggtcaggggactcaccgccctgcctggacagcaggaagaggaagaggagggggaccacccaggtcaccagcggctccatcggatccacgtagagccccacagccccaggggagcctctctgccacctgcgaggttcagccacc

SEQ ID NO: 1791 - DNA, 7815 bp, Homo sapiens
  source 1..7815: mol_type = genomic DNA
aaattattaatactttattatattagcactgaatatattaatttttctcctaacattttagatatcaaatataaagtgtagtacatacacacatacattgtgaatattttctgtttccatccgtgcaggtcttattaagagtcctgtgaagtggagggaattgggggtcagacaggacttgttgcagagcactgggtaaggagtggcatttctacagcttcttcagctgagtggatatgcacctcttactgcacatggtggatgacaggggtgacgcaggtgcagccaacagtcaccagcaccttctccaactggaaagaaacagagcagccttggtgcttcctccggacgaccagggtctcttgctggatgggaacggaattcatggagatgtcttcctttccttgagcattgatgcagcccaagttcctacactgggcctgtacaacttccgaggggtaccggttggggtcccaagtgacactgcaggaggagcaagccaaagcacaatggtgaggcatgggggaggaagacagcgaatgagagccccacagcactgagtgttcacctgcagggaggcagttctgcagggctgtggcacaggttctggagccacacagcctggaagcatacaccagcctctggcagtggcttacctttctaagcctcagtttcctcaactataagatggggattttcatataccattttctcatgcaactgttgagaatactcagtgatacaagtacatataaaataccccactgtacaaatgttagcattcaattaacattagatctttcattggcattattattattattattacaattctttattctctgcctggagattgaacgtcactagtcagtcttccatcactagtcggtctacagagcctgctgcttggaaaggaaagccacagccccagaggtctgtgaatctcagaccttctctccatttctcctttaataggcccctctgcctggaggcataaagaccacaacatttatcctgccagcttgccattgtacatattccacttgtagtgtgacaggacccccaccaggttacttgagggtgtgtgtccactgtctgaaccctgaaggacgggcagtgagccaaggccaccatgcacagccaaggagcaggccaccgagaacccaaacatctcagagagtatctgagaacctaccaaggaaaacagtcccattggacacacacagtaggcaaagagccagaaaattcgcttaagagcagcttagagatgggaggcagagcggatctctagatctgtcctgctgtggccctagggcgccccatagtaagtcttaataaactcatccactcgctaagctggacttgtccaagtcattctttgatctctccatatcttcccagttcgaggcagggggcactaccgtcccaaggttttctcataacacactcacatgagaagctatgtgacaaccccagaagcacttcaattgtccctggaatctactttgatacttacatttggagagtatgagggagtgcttggtcttccaagaacctgtatcttaatgccaaattacaagactgtaccctgaaggtctccacctaacatcccatttcccagactggcctttctcctccactcattcccactccttaaatgataatgtctaatctgagtgaatctccttaaaccgacttttctgtttcccatttatcctcatgaggagataattatgcaatctgctttaaagaaccctctcttccaacacaggaaaatttgtgaattctatcctagaactacatgaagcagaaaaaggcacaaagtctatgagaacgtggaagcaaaatattaggaccatcaaccacaaaggtgaacctagtccaaaacaagaaagatatgagctcccaggtaaagtgaaattttcattgttaagaggattttcccttttattttttctatgtattctacattttctactttatgattagaatgaattaacatatttttccaaagaatgtgaaaatcagtctcatttgcacttacgtgtaattccagggggaggtggagcggctctcgatgttacgtgacatggaaacgcgctggttttcattgatgatgccaatgtcaagcttcatactacctcctggcacaggcgggcaactctcaggcttttggaaaaaagtatgtcctactttggggattttccgagctgccgcctcactcagaaaggcaagccccaatatcgacagcagcaagtacttgacctggaaaatagaagacgctgcaatcagttagagactcgcctcacctactagcaagagatgcatggtctggcggaactcagcattcctgtccttttatgggatcagggcttctctttgcacctcagttcctcacctggaaatgggaacactcacacctaaaggtatcaaggtgccaaactgagaactaaactcagtagcctagctagtaactgaagccctccatagtctaaaagctcccaaacagtgagacagaaagatgcaagggtctgagattgagttaaaatcctatcctggcttccttgctgagcctctagtttctcttccttccaactggataataatgctcactttatgagactactaatgagattaaatagaatgttctatataaaacacctataaatctgtataagaaaaatagaggcttaataaacgatagctcttgtttttatttccaacttgatatcccatgaatctcccacaaaatccttcttcggagccacccctctacctagaatacactgcctagaatactctgtctgtcaaaatcctacccttccattaaggcccagctcagatgtgatctcctctaagaacagtccctaaaatggttcaatcagaagcatgtttattatccttaaattataaagctttgatcatctagcactcaagcagcattttttaattgtctagaaatgtagtatttgtgttcctgtcagatctacacccattagattgtaagttcctgcatattacacattttccataaacacttttggaatgaatgagtgaatgagtgaatgaatgaacaaaatgatacagctaaattgaactatatagttaagctcactgcattaagaaaaacattacgcaaaaccaacgatagcaaagttccaattatccatgctaattgaaagaaaccggggcactaatgatgcaccacaagagagaatatggaaactatttctctttagctctggagcattttttttatacttacgttgaaatgccagtttatctggtgttataggaatgcgcaaagaatgaaagtgcactgaagacctaatgaaaagaaaagctacaaatcttgccagattccctttgtcacaaccatgctttgctcacccaccattgccactgacccttactggggatgagcaaggcccatcaccaactctcaacataatacagaagaagagctgaaggccgggtgcagtggctcacgcctgtaatcccagcattttgggaagccgaggtgggtggatcacctgaagtcaggagttcaggaccagcctggccaacatggtgaaacctcgtctctactaaaaatataaaaattagccaggcgtggtggtgcacgcctgcaatcccagctactcgggaggctgaggcaggagaatcctttgaacctaggaggtggaggttgcagtgagccgaaattgcaccactgcactccagcctgggcgacagtgcgagactcctgcttggaaaaaaaaaaaaaaaaaaaagagctgaaaataagttgcttttattctctaggcttagcgttgttcaggctcacaccttccatgagttaaggtagggaaggtgattagacatgttggtttcaaaggccttccttttcatattttgcagatactagagacaaaaaacaataagagtaaacaaaaaggtcatagtgtccatttgccatactgaggaagctgacactaaaaagaagttgaaagcaagattgacccagaagagtcagaatgaggctgatttgcctttagataatcagcaatcatcaactttcatcccccacaatcgttcattcattcaacaactagctcttgactttacagtgtggtagctcagggcatgggcttcagagtcagaagtccagggtctgtaactcaattccaggactcttagaagcgatgactctgtttcctcaaaaaaaaaaaaaatgtgaagattaaatgagatgatccatataaattatgaagaacactggcagcatatgataagtatccaatactggcgactcttgctaactctatattgtgctacacagtggactagacagatgtggaatttacactcatataccttgtcttgacaaactgctatggcgtttgtttgtttgtttgtttgtttgtttgttttgatggagtctcactctgtcgcccaggctggagtacagtggcacaatcttggtttactgcaatctccgcctcccaggttcaagcgattctcctgcctcagccttccgagtagctgggattacatacgtgcgccaccacacctgataattttttgtatttttagtagatatagggtttcatcatgtggtcaggctggtcttgaactcctgacctcaagtgatctgcccacctcggcctcccaaaatgctgggattacaggcctgagctaccgcgcctggcctgctatgactttttttttaaaagatgccaacttatattagagggtcttagataacttcccaagcctaccaatcacatatttagggttcttaagtaaattcctcctttgtgttttctctttcctcttctgtgtcatactcactgaatcactattaattttcattatgaaaacttttaaatacatacattggagttatatgacttagcaataattacaatgcttctaacaagtcattattacatttgcttatatattcttagagtatattagaaaattcttttacatctctttaaacactggattttcacaactacctggtgaggtaatcagagctagtattaattatcccaattagacaggtgaaagagttctgtcccagagggaataaataacttgattgggttcaccagcctatgagtaccagtctggggactcaaacctaggtgtcagtagtcagtgctattgtcattgaaggtcatttttattattaccaacattaatcttagttttgtctcattagaagagctaagtgttttaggtaatgtgacagctgtactagatgtgcataagtgttgtaggtcacatagctcgttatcaggaaatcagatgatgtctgcaaatactccaatttgctccacaaagcttttgatctgaaactgtagattttagtggttatgtaatacagagcaggggctctgaaccaggctgttgctggttcttaagaatgatttaaacagcacctctcagagaaatccagagcatgacttgaactcttatatgccacctataaagcagatgaatagatatcgctctcaatctgtataataggggacaggggcaagggaaagcaccaggtgaaggtgagctgtaacaggacaacaaccttctcagcctagctttgcacctcactctaatgtgagctcacctgagcaacctgaacatccatcctctatactcaccagcaatgtgtggacacatgtaagcatgcacctggccaacctctaggtccatgagaatttgcctcaactacttattgaagatgtcctatctgcctgcacctctcaacttctaatcctattccaatgctccttgcactgttatgtttcttgctgacaacccaacagatttctttaaggaaactagaattagaaatagctatggagcacaaagctacccaacagaattgcttggatgcaatggctttaaattcacaaatcttgcctctgaaccaaagaaaagcatactgtatgtggagacagaaagcttagattggtgtaccagttcttgtgcttacagtatccagcaatgttaaataaatagcttaattgagcttttgttcatctgtataaagtggaaagtattcccatctacttcagtggattgatcagaatttccaggacaataataacaatattaatatgaacagttaacacttactgaatgctttctctatcattatcagtcgttgtttattagaatggccaaattaactgaaaattaagcatacacaaatctgccagtacagagtatagactcatttattctcaaagatattaattaatcctcccaataaatgccatgagaaagatgccattgttatccccaccatacagttgaggaaacggaggcacagagaagataaataacttacccaaaaatcctacatttagcaagcagtggagccaggtctgcctgacatcaaagcctatgcccctaaatatggcactttgctgagctacatgtaatctttaaaataacacataaatataaaataaaacataccattgctatatgccatgaaccttttatgatattcaagctcttttaagttgtatggcttgtaaaaggagaaaaaaaggaaattatctaagccaataatatgatgcgggatttcctaacccctgttttcatgtacctctatagtaaattcttctcaggccttatctgactaatgtcaggcaagattccagacctgctggggctagattttcattgcattaacatctctctttcctccaagaagaatgagatggtacaaaataaataaatagcaatcagagacatgggaaatttcccttctctaggagctgtccaaagtcaacactgggtgatttcatttcttccatccagggcactcctgtaatctcaggggaatcattaaacctcttgaggccccagtttccttggttaaaatgtatatgtacataatccctaaagtgctggccaagctcccaccatgagataagaatttcaggccaacctgactctataatggatggccacaggaaagaacatgctagttgtctgtgatgccaaggactgcacacactaacaccacctgggcacacactaacaccacctgggcaaaagccattgggtgaggagctgcatttttttttctttgagacagagtctcgctatgtcacccaggatggagtgcagtggcgtgatcttggctcattgcaacctccgcctcccaggttcaagccattctcctgcctcagcctcccgagtagctgggattacaggcaactgacccatgcccagctaatttttgtatttttagtagagacagggtttcaagttagtcaggctggtctcaaacccctgacctcaagtgatccacccacctcagcctctcaaagtgctgggattacaggcgtgagccaccaggctcgacctaatttctgtatttttagtagagaccgggtttcgctatgttggtcaggctggtctcgaactcctgaactcatgtgacccgcccgccttggcctcctaaagtgctgggattacaggcatgagccaccacgcctggccaggagctgcatttttatgccattataacttttctagttatttttttctttttctccaccagacaggagtcaaaattaaagtcatctctgttttttaagaagtaattccaaaaagaccccaatcaaacctaattccttaggattctgttttctgaaatcctaggcatgacagtccttaaaccagaatgattgctgctactcaccatggctgggccatgcagggtcttcactgtcatgttgcgctggtggcttactttgtgcaggaagctctttctgtgaatgtatcttcctgtgtatgcctgtgttc

SEQ ID NO: 1792 - DNA, 30736 bp, Homo sapiens
  source 1..30736: mol_type = genomic DNA
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggtgagactcgacgtggggagcggtagccgccaggatgctgcggacgcggggcaaggtcgcggagggccggacggtcgggactacgcgcccgggctggggaggcaggaagtccgcgccgcgggcttagaggggctcagagccttgggcacagatatcgcggcgcctggggaggaccctcggagcggtgggagttgcggtgtggaatacggggggggtgggtggcacatcgcgcggcgcgtgttgcacaacctggcccgccgtcgtgactggaggcgggagtgacacctccgcccgggccgcggagttcggggaaggagggcgcggcgctgggccaggccggaggggcggccagggctgatagaaaggggctgtggagaaggggcccggggaggagccaggacgggtctggacccagctccacgccttgcgcccctcacgtaccccggcggggcacggtcggccctcgggaggcccatcgcgccctcgggagcttccctcaagccgtgcccttcatgccgccgacggagccgggcgagcccacgtcgtccgtgcggaaggtggagtccctcacccgcggcccccagagggaccccgctgtcgtagagccacgcgggggccggagcgctgagacgcggcaccatgtttcggggagagctctgccgagggcggctgagggccacctccccagaggcgcgaagccctgaggatgggcagatggttcttaagacggcgcccttcccgccactcccacccccgactaccaccacctgggtctgggaacccggtgagagcgcagtcggagggtcgaacgtttgtagctgtcaagtcgtagccccgctgcgcccacaggaagtgacccacccgcctgccgggtagtggcctttctgtgagccaggaccatcttaaggaaaaaaacaaaaaaagagcaaaacgccgtgcccctccacaatatactctcctcttccccgcatccccgaggggatctttcctcccctccacctccacctccacctccaccgctgaccccaaggaataatgctcagtatctgagtcagaggatgtaaaacaaagggatatttctccttatgtagttttatggaggatttaccgaaagaaggtggagggtgagtgactatgtcgcagaaaaaaaaaaaaagatgtttttatcgtgaatgatgttgagaaatgtcctgtgacttccactattgggcaaagcaggtccctctgccctgctagtccctcctgcaggctgtgtatgaagcgttctgatatggagggttggtgcgcctgggttgacagccattggtcaggtgcctgcagagtacagggcgccatactgggaactggaactataaataaatactctggggaccctaatatccagagacctaacccatctacgggaggaacaaggcttgaagttagggaactgtctagcaaagctgcttgcacaactgctaagtgtacggaattccaggaaaaagaaaaattgcttccagttggggtgtccttcatggaaaaggcatttgggcagccctgtgggggtagcaggagcattccaggtggtggaaagggcctgagccaaggtccttaagtgggacagggtacggtgtgtggccggaatggagggtctgtgtaataggacagtgagaaaagatgccagaagcggggatgggactctgctgtgcgtggcgtgggagccaagctctgactttcactgcacagtgaagcaactgtaagtcaggagcagaagcacggcctggctccagggagggctgaagagagacacttgctgttcatatttgtctgcagtctctcgttctcttccttcctctctctctcttctgtatacacctgcctcacagacagctcttctccagagatagacagctctgggctccattgactagttcttttaaaaagaaagaaaacacatccttcaaatttctgtccctcactggtgttttagtggatgcaatgtggtatagtgaggggagggaaggccacagaggtggccagaggacctggatttgcaggcagcatcgcacttactgtctctgcagtcgggctttgaggctgcctgggcctgggttccctcatttccacaaaggcaggactgggtgagccttctcaaagtaagtccatgccaccttccagaatgtaagtgtctgtccaaagcccagttcgatttagccttccataactatcctcagacagggaggaggcttctgcacacctggcctgttcctagctcagtgctggagcacaggatgcgggggctatttgatacatatgtgttgactgaacaaaagaatgcatgaatgaaggaaagaacggtcagctctgcttggaaggtagtggcaagctgagaccaaccatagcaatggttccagatgcttggggttagcacctcaaaacccagatgactgatttccccacagaaatcattacacgagaaaccatcaataattgcatttccctgggagtttccttttggttagccgttctcgctgcctaggcttcatgcaggtttcccatgaccgccagcctggaggaatgcccataggaaagacagcagcaacttaagagttggtcagggtaaatgttaacacgtaatttcatagacaggatgtgtatttcattacagagtcttttttcctgagcgtttgcggttttgacttgtggttgtagaacagctgctcagtttaacccctttatcttttgcttgccagaagccactttcatcatgccactcttccagaggctacaaagttgtgttctttgtgccaggcactgtgccggtggctcacaagtattccttcatcccatactcaacgacagcttacaaggttggcaggatgaacctgcttttgagaggctgggttattggcccaaggtcgcacagctaatgagtgctaaggtgagattgaaagcaggctgtgcttgtaagttcaaagcccactttctctgtcaggcactcagtagtgttcactgaggcacagaattgaatacaatcttccatttcttcctcttaaccttcaccttgtgggtagagaatagtggcctattggaggtatcccttatttatttatttatttatttatattttgagagagttttgctctgtcgcccaggctggagtgcagtggtgcgatctcagctcactgcaacctccgcctcccgagttcaagcaattcttgtgcctcagcctcccgagtcattgggattacaggcgcccaccactacacccagccgatttttgttttttgtttttttgacacagaaagacactgtcgcccaggctacagtgcagtggcatgatctcggctcactgcaacatccacctcccaggtttgagcgattcttctgcctcagcctcccaagtagctgggactagcaggcatgcaccatgatgcccagctaatttttgttatttttagtagagatggggtttcaccatattggccaggctgatctggaactcctgacctcaagtgttctgcccacctcggcctcccaaagtgctgggattacaggtgtgagccaccgcacctggccaatttttttatttttatttttattttgagacaaggtctcactctgtcatccagattggagtgcagtggtgcgatctcagctcactgcaacctccacttcccaggctcaagcgattctcctgcctcaacctcccaagtagctgggattacaggtgcgcaccaccactcccagctaatttttgtatttttagtagagtcggggtttcaccatgttggccaggctggtctcgaattcctgacttcaaatgatctacctgcctcggcctcccaaaatgctgggattacaagcgtgagccaatgcgcctggccaattttttaatttttttagtagagacagggtttcaccaggttggccagactggtctcgaactctttatctgcccacctcggcctccaaaaatgttgggattacaggtgtgagcaaccacacctggccccttttgttatttagagagacaaggcagcagagattaagatcatgtattctggagcaaaacttcgtcatgcaaatgccagctctgtgggaccttgagccacttacccaacctccctgggtcttagttttttcatcagtacaattgggataagggtgcttagctcataggattgttgtcaagatcaaatgagatatatgtacaaagtgcttagcatgatgccagacacaaaagaggagctcaataaacatcagctgccatcaccttcattgtcatgacaatcccccctctgatttctgcaagatgcctcacgtaatgccattcacaagcaggtagctcatagataatattctgattctgctagttttaaagaatgggcagtggccccacgcctgtaatcctagcattttgggaggctgaggcaagggaatcacttaagcccaggagttcaagaccagtctgggcaacatggcaaaaccctgtctctacaaaaaatacaaaaattagccaggtgtggtggcgcatgtctctagtctgagctactgaggaggccgaagtgggaggatctcttgcgcccaagaggtcaacactgcactgagccctgagcatgctgctgcatgacagagtgagaccctgtctcaaaaaacaaacaaacaaaaaaaaaaacgaatgagaggtttgaaattagggatgactattggagaggaatttgttggacaagacaagatatgtcttagtaatatcctaagaagatcccgaacactttttttttttgctttatttaaaatgttatgtaattctataaattttttttttcttagagacggagtctcgctctgtcacccaggctggagtgcaggggcgcaatctctgctcactgcagcttctgcctcctgggttctagcagctctcctgtctcagcctcccgagtagctgggactacaggcgcacgcctccatgcctggctaattttttgtattttagtagagatggggtttcaccgttgttggccaggccagtctcgaactcctgagctcaggcaatccacctgcctcggcctcccaaagtgctaggattacaggcgtgagccatgaaattaaattataaggaaaaaaatgtctactctttcttccactaaacaaattaatgttttcattcatttatcttacttttcagtcctttcatttgtttggcattacatcatagataaacttctatcttttaattaatttttgtcaagttacgtatggtgatcctcctttaaaaatggtactaagatgtttaaaacaaaaaacagtagatccctgcgccacccctaaacctgctccccaaatatgattcctttagttaattcttctgagatatacctccatatttctaaacatgcttatagtgttaattcatgatttgttaattttagatattatctattgacttctaatagatgaaaattacattatctttctgccaccacttctccctgttttttattacagttaaatcatgattttagttaaattaatagtcagcatttatataacaattaagtaatcttcactgctgaggcaagtaagtgtactttgattatatattttttctggtacaattcccctcccctcctgccccagagataataattgctttaattcttcacttgcataatgtttcatgtaactagtcttagttttgttctatcagacttgtcatatcatttccctccaaatcatcagatattccatcaattccatcccccgctttccccagagaacttcctcctagagcacactgttctccagccccagcaaggtctgtgctctctagacctgtggcacaacaggtctagaccagaacagacatcctgtcatggtctaatctcccatgtcctggatcctgtgtcttcttcctcaggggttactccctcattttgctggagaatatcatcctgtaatttcctaagcatatgtatgagggatggatatagacatatatatcaggaacatatatgttaagtcttttcatgtcaacatatctttattctaccctcatacctttttctgataatttggctgggtgtgaaaattatgtgttaaagataattttccctcagaattgtgaaagcattgctttattgccttctagcaaacagtacagatgctaagaaagtcaatgttattggccgggcgccgtagcttacgcctataatcccagcactttgggaggccgaggcgggcggatcacgaggtcaggagattgagaccatcctgtctaacgcagtgaaaccccgtctctactaaaaatacaaaaaaaaattagccaggcgtggtggtggcgcctgtagtcccagctacttgggaggctgaggcagaagaatggggggaacctgggaggcggggcttgcagtgagctgagatcgcaccactgcactccagcctgggtgacagagcgagactctgtctcaaaaaaaaaaaagtcaatgttattatgtgtcttattggtttatatgacacttatttttttctctctggaaacttttaggatcttctttttattcctgatattacaacagtttcaagatttggggccttggtctgggtcttcgttgttgtttttgtgcaggccatttagtaacctttttaatttggcaacgtgatactgtgaaatatgtatttagtcttcaacccctttttctggcatagaactcctaaaatccttagaatctccaaaattgtatcttttatatactaatgattcattggtggctggcagcctctaggcagcttcaggatgggggctggtcccgggaagcaagttaggattagagggctgggacgtttagccccacccctttacccatcacatctgggaaggggagagggaactgaaggccccctgaagttgcaatggccagtggtttaatcagtcatgctcacatgaagcctccataaaaacggggttcagagagcttccaggtagtggaacatgtggaggttcctggagggtggcacacctgaggagggcatggaagctttgtactccttctcctatacctcaccttttcttctgtattatttgtgatatccttaaaataaactgggaaatgtgtttccctgagttctctgagcagctttagcaaattaattgaactgaaagagaggagcatgagaatctcacgttgaacccggttggtcttagaagttctggaggcccagacttaccactggtgtctagggggtgggcggtcttggggactgagcactcaacctgtgggatctgatgctatctccaaatagtgtcagaattaaattggaggatacccagctggtgtctgctgccgaattgattgcttgcttggtggtgggaagaaaccaccccccgccaatatgtagtcacagaagtcttctgtgacttctgttgattgttgtggtgatgtgagggcagaggaaaaatacagcttgagtttttccacactctcggggaatatgtgtccttctcttccagaatattttctttctttccttttttaaaaaataacttcttccttctgtttttttgttaatctccttctagaaatctagtcaatcatattttgtttcctaaattgaatctctaatgatcatatattttttcctattctatttgtgctttcagagaaatgtcctcaatttcatagactaacccttctattgaatttttatttagtagaacttctattgagtttcaaggttcagttttcattctctgcctgctcatttgtccatggtgtcctgcccctgtcttacagatgcagtgttgtatctcttcggggctataataattttacttgtttggtttaattgtgttaacagcattgttttttttttccttccaggagcattttttaattgttttgatctatttttcatacagaaaacctatctcaaatatctggtactccttggctgtctgagaatattttaagaatgaagtcctaaaagctgattaaatgctctgtgtagttaaggtttattgaacattggacttcactgtataggaggtcaagctaatcgtgaacctggcctattgggtgacctccaaatgctgaaatctggaggtgttttttttgggcctggctgccagcattctgagatcagagcacggaaagagaggataaggttcccaacactccatatgtagaccttcacttaattctccctgcccctaagccctgaacgttataaggttctgaggggcccctggcctccttatcaataactcccttttgtagcattcagacagaagttcctccactcagcacaagccagctgcctactctgctgccacttggacagttatttatttattcattcatttgttcatttttgaggttttataattttatttgacatcaacagtttgttctcatccacaatgtctgactgtcagtttctgaaagtggtaatgggtacacaggtaaccaaagtatagagcttgcttggtgaatcttcatcctcatgctttctggacagctgcacatggacacagtatggaacgttccttattcctttggtccagacagctttgttgagcctggtgttagcatatctggagtccccatctccttcatggcaaagttctgggactttttgagtgaccaaggggcacactgcttgacgtcccctccatgggtgtgcttgtggatgctgatggcatattctggtgtcaccacctcattggtggcaggtgacagaatagcccttttattttattttatcttactttattttattttattttattttatttagacagagtctcgctctgtcgcccaggatagagtacagtggcacagtcttggctcactgaagcctctgcctcccaggttcaagcaattctcccacctcagcctctcaaatagctgggactacaggcacatgccaccacacccagctaatttttgtatttttagtagagacagggtttcaccatctcttggccaggctggtcttaaactcctgacttcaggtgatccacctacctcagcctcccaaaagtgctgggattacacgcatgagccactgcgcccagccaacactcttctttacaggagctatgctgctggggccaagttggaaaggacttttaaaattttgttcacatcttttgtccactgagtttggctctttgagtttgagaatttacaaaaaaaaatgttctttcctataattgttatattgtttggagagagggagaaaatatgtgtatatggtcaatgcgctattacctctaatagaattgttattctatatttcacctatatgtatatttttcagttttgattaaatcttttttccccttatcttccctcatgccatctcctctgcttgtgtgccctttgcccccagcaaactgtgttaacacctgttaacatgtttctattctcatttagtcatacacacactctctctctctctctctctctctctctctctctctatatatatatatatatatatatatattcagggagatctttttcatgacttatttccatagaaattgggatcatactataaaaagttatttgaaacttattttcctctctcatcaacacattccagccatctgcaggtcaacagatgtctatgcaactaattctcattctctttaatatttgcataatattccatagtagatagcaatctattcaaccatttctagtttgatggacatttagatttaaactagatctcaccttaattcagccattctctattgatgaccattcagtaccacagaaaaagagggaaagctgtccattttttttaaagctagtataagcttaattctaaaacttgacaaatcttatacaaaaagaaaaactatggaccaatctcatttatgaacataaatccatgcaattctaaataaaatattagcaaatgtaatctagcagaatatcaaaagaacaatgcaccataatctagtggtgcattaacaaactttgtttgttaatcagtgctggagaggtatatgatgaggttcagagctgttttgaatgaaaactataaacctaatagtaactgaaggaaaagacttatatgcaaccacaactatcagaaaccaagaccaaaaacagtattccatagggcataccaaactatttccctccatctcgggaatgagaggacacctgcctgcaccactgggaatcaaccaagtgtgttgtcagacccttccactttccttgtggtcttcatgaagacaagagcttttcatcatgggcatcatcctgcagtgttattgagtagctcccagtggctagtaggaagttactccaaatgatgtatctgtttgccttctctagaagagttccccatctcaaggtgaaataaccgctttttttttatcctccacatcctaggaattttaagggagaggaaaaatgagaggactcaggggagttaatcttctcgccatttaggaaagagtgacatttattagtgtgagcctaggcagccagatggattttgttgggaacatgtgcggagccccctagtggggtggtgatgctagcccgggacctgtaggggagaattcaggagctgaacagggcgagaagcacttatgaactggggtcccagagaaggagggtccaggtgaaatagcttgctagagtcaatcctaggtgcgtgcagatgtcatcctgtgtgtgaccactctgtaaatgaaccctggtggcacggggtcttctcctgtgcttagccctacctctctgttccctctcaagagagaggagggtgtcagccctggcaccctactcacaccagtcactttgttggccttgagattgtgtttctggtctgcctcagcatctgactttccaccccgggatgcgtttggtctgttttgccagttagagaactggagacacctgagcctgagctccttcctaatggttacatttccctggtagcatttgtcactagggcttctaaatttggccatcaggatttcctcaggcttggaaggttaacacatactgcccaagagggaggcaatataatgtaacatgggtgcctcagcttcctcatctgcagaatgggctgaggataatacctcgtcacgatcacccggaacagggcctggcatactttacctagcgactttgtagggacttagtgaatgttccccaacagatctgtcacagaaactgtaaatattgcccttcaccccttccgcacctcttgcagcagtgttatccaggaaggttggaaaccttaggagatgaaggggcccttttctcagggcactccaagagaaccctctcagtgtcttttaaaattgtcaaggtcccagctcatagcagttcctcataaaataccattcctgtgccgggcgcggtggctcacgcttgtaatcccagcactttgggaggccgaggcaggcggatcacgaggtcaggagatcgagatcatcctggctaacacagtgaaatcccgtctctactaaaaacacaaaaaagtagccgggcgtggtggcgggcgcctgtagtcccagctacctgggaggccgaggcaggagaatggcgtgaacccgggaggcggagcttgcagtgagctgagatcgcgccactgcactccagcctgggcgacagagcaagactccatctcaaaaaaaaaaaaaaaaaagcaccattccctttgccatcccctggactcactcctcatcctattccccaaaaagtgagaagggcaggctgtgtagatggcattcctgagaatgagccagtggagagcatctggccctggcatgtgaattcaagccttttcccagctgtaataaccaccctcttttttccacaggggctaaactgcacggtcaagaatagtaagtcatctttttctgttcttcttcttgttgccttcttaatcaagtgagagcctgctgccaacttctgacagaagtcttgccatgccactccaggttcaggctgtgagctacagccatccgcaggagggttcccggagaattgtggatgcgtgcacctgcgcttcctgtcgagaacattcattatgcaaaagtcaggaaaggagaaacagaactgtcatttggattgtgaaagtattctctggggagctgccctactgtatctataatataatttgatttgccacagcttgtcactgtaaagtgagagacatctgtgctgttgattttgttttgttttaattcaaagaggcacatattcaagtgtctgagccaattagagacccctgacatataacaataaagcagctcttactacaactgcatccctcctgtgcccttattcccaatcacaacttcttctcaaaatcaacttgtgtactttgtcttctctcctaaaattccctttagacttgagaggtttgcagtgaccccagtaaacattagagaagagggagcagggcagtaaagctgaggacgcggccaagggccacaggctggaaggccgcgggcccctgagctgtttgctgtctagctgtctgtacctgctgctggggcatctcagggtctcggctataagtctctgaatgttgcttttccctggctgccaggtacctgcctggatgacagctggattcaccctcgaaacctgaccccctcctccccaaaggacctgcagatccagctgcactttgcccacacccaacaaggagacctgttccccgtggctcacatcgaatggacactgcagacagacggtgagtgggcatgccagcagggccctgggggattctccctgcctccaagtggctctcccagtcaggctcaggattgggctcccagtcctgtgctcagacatgggggttcaaatttagtgctataaggatccgtcatttcatgcagtcaaatacttgttcagcattttagatattaacccacagtgataccttctcatcacaccattcttcatgaaaggacttccttcaacctaatatttttagcaccctgaggggaaaaaaaagcaagcagttaattttgtgactacagtaccaaaaatgaagtggaaaatggtaacacatttgtcaacctgttccctgaatttaggggccagcacttttaaaacgtcccccaagcctattcaggaatggagagtttatgttacagaattgggacgattggggcttatgagcactagccccagatttgtgaacggggcatgggggaagttctttttggaagtccccgccctcagtgctcctgctgacagccacaacctcgtgaggatggtggggatggctgtgtttgacacccatgccagattgtcaaagccctcaccacaagtttgcaaagcctttacttctagcccagtgtaaagtgtcatttttccttgcccagctgggaaataactgtctgcaaggcggtaggctgaggccagagagtgaactgaaaggaacaggatgtggagagttgggtaagacggcagattttcttttaggagtgaacaaccgcaacagatagggaagtgacacacccagcacttgtcttggctgatctgcatctgtttgtcttctcttctccctctcctgcagccagcatcctgtacctcgagggtgcagagttatctgtcctgcagctgaacaccaatgaacgtttgtgcgtcaggtttgagtttctgtccaaactgaggcatcaccacaggcgggtaagaacacagctcctgagtggattatgttccactgatgacaccagtacagacttcttgtccccaaattcagaccctgatttagagtgggggagacccagaggtgctgagggagtctgtggaattcagaatggcagcctgagatgggcagaagtcaaaagagaagtggtgtggccgccgtgagcaatagtgagggacagagcgtatttttgaaagcgtccctcacctgctcacccctggtttttcttcccactttacctagctattcgttcggaaaggaagttgaattggaaggcagcttccacagccctacctcctgccatctttgtgtaactttgtgtaacatcttttatgtgtaacttggattcagctggggcctaccttcaggaagaaaaaaccgcccagaccaaagaactgctgtaggtgggcaaatgagcactacaacagcttagtctcattttgctgctcacagctaaatggtgaaatgttgattcttgtttaagtttgtttaaagcagtgggtctcaaagtgtggtccgtagaccagcagcctcagcctcacctgggaacgtggtagagatgtttggccccaccccagacttcccaggccagaaactcttagggtggggtccagcaactggtgcttaacccttaagtcatcacgatgcgagccttagtttgaagactactggtttaaatctgcaaatggtcacttgaaaacaagttagatctcccacaaactcaagcagcaaaggcagaacccctctccgatgttaaattaggacccccaaacttgactgctatgcgaatggtgagaaccaggttcctccgtccacttagaagcaaaggaccccggcccctccaccagggtaactagaatgggggttggagtcgatgtctgtaatctctaacacccagaaaataacttagcacaaattcaaatatcattgcaactgaggtgcctgctggcccagggtgagtgggggtctctagcttgtcctttgcacctttttactccataatggtctcaagaggttcctggcttttccgtttgaggaggaagaatcatttgacaaatagtttttacctgcctggcgtgtgccagatctccatagccccaagtcccctggctccgccctctcatacccattgtcctagaatttgagagggcaggtgggaggggtgggactacttccactttccccaaattcttttgccttattcactgtctactgatgaggccagatccaggtttaaaaaaaaaaaaaaaaaaaacaggcagaaaggaccagaggaaacaaaaaacaaagatactgatttccctgaccttggattttgctgtggttgttgctttgttcttatttttggctgaatattcgggagtgggtgggaacgggggtctttgggcatagatgggtgacagaggtgtgtgtaatccatccaccttcccttcctcccttctcttcagtggcgttttaccttcagccactttgtggttgaccctgaccaggaatatgaggtgaccgttcaccacctgcccaagcccatccctgatggggacccaaaccaccagtccaagaatttccttgtgcctggtaagagcatcctcccaagacattccctccccaatggcctctgtgagaaggaagcaccaggtggcacagatgccagcccccctgctcagcaagacattggctggcattgccagcacctgggacccacagaacaaacagaggccaagactgggagtgctttggtgtgtgctgcaacctccattccctgaggcagaggccattctctgttggcacaacagtggacggtggcccaagatcccaggagttttatgggaaccagagcacctccctctatctagagaagcacccagcctgcccagaaaatagcataaaggcaagccacaagccactcgtggggaagttgcagcctctgcccccagcctggtcccagcctccgtggcttgctcttctccttccaccttacattctgcctgcatcatccaacgttcatcccatgcatggcgctctactccccatgcctatccacactgcctgtgattaccgccaggcttttcttctcaggcatcctttgatgtacatgtaccttctacttctctgtcctccccagaagctcagctattacctacatttctctctttttgtttttaatagagatagggtcttgctttgtcacccaggctatagtgcaattttgctatcctagctcaatgcagcctcgaactcctgggctcatgcgattctcctgcctcagtctctctacaattctctgtccatagccagctatgtcaggaagcccacttgaaaacaaagcctgggtcttctgcccatttttataatctccagaacctcacgaattgccttgcatatagtaggttggtcaagaaatgcttgttaaggatggtgttgaccttcttcatcctgggaccaccctgcacacacgcgtgcacacacactctgtgcttaccctgctttatgtcaccgcgtgtggctcatcactccctgactggtactgcatgctgtgtgtttgcttttattggtctcttctactgggttgcaatctccagggggcagggctttgtcttgtttaccactgtacctccagtgccaagaacagggcctggtgcatagttggtgctcaatatgtatttgttgaaggagtgaatctcctcagttctcgcttctgttcctaaagttgactgactcagtccctgtccctccatggtgattcacacctgtcacatgtcttctcagcctgtgcaaagacaggggcagccggggacaagaagctgtgggtgggcagagaaggaactggaggggaccaagattgcttggtcacccacagcaagctcaggaggaatgcacttgcatcaggagggttccccgagagatgaggatcagacaggcaggctggcacccatgccaaggtgggtccagccctggagctcactctgaaggggccacctgcggacaggctcccagtggggaaaagattgttgttcttggtgtcaggagtctggaagaacagatttctgaaggcagaggcttaatgagtttccttttttctgggtcgacagactgtgagcacgccaggatgaaggtaaccacgccatgcatgagctcaggtaacagctggcccgggagagctttatttggatgcatacacatgcacatgtgcgtgcccctcctcactcccagcctgcgtgtgtgaccttggcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcggtaactctgctctttttgacccctctagcatagctcaggaccacccctccaagccctgagtctcttctctgctggtctgacagaaccgcgttgctagaagctcgcgactcagggctgtgcttagtccatagtgatcatggcgccttgccctttttcttccccagtgatcttatgcttgatagaaaggcagttgactgtgtcctgcccatgactcagtcctttttgttctttcctcccccacacgcccccttgttctctttttgttttgctttgtttattacaaaaaggatttgaggatttaaaaaaaagaagaaatgtgaaaatagagacaaaggggaactaaagataaggaaataaggccaggtgcagtggctcccacctgtaatcccaatactttgggaggccaaggcaggagaatggcttgaagttggagttcgagactacagtaagccatgatggcaccactgcacccactctgggggacagagcgagaccctgtctctaaaaaagaaaataaaaattgaaaaataaataaagtacattaatgacataaaatatgccaggcacagtggttcacgcctataatcccagcagtttgggaggccaaggcaggtggatcacttgaggtcaggagttcgagaccagcctgaccaacatgatgaaaccccatctctactaaaagtacaaaaattagccaggtgtgctggcacacgcctgtaatcccagcaatttgggaaactgaggcagaagaatcacttgaacctgggaggcagaggttgtagtgagctgagattgtgccactgcactccagcctgggtgacaagagtgatactccatctctaaaaaaaaagaaataaaggtaatacgatgaagccagctcagtgcaggaaacgtgtgctgtgtggttctgtacaactggtgtccatgaacacagatttgttgccccaattcccagcagccaaagcaaagagagacttaccagttactacacgtacttaaggatttacaataaaccagcttccatgcagaaacggagtttttttctggaatagaaacctgaaaagcatttctcccctggccttcctaaggggtgctctggacagcctctccatggcagtgccacagcgtgttcttacccaactagccttacccatcccaactagccttacccatcctcgcctctctcctcagcccagaccagaagagttccaccagcgatccaacgtcacactcactctacgcaaccttaaagggtgctgtcgccaccaagtgcaggtgggtgagtgtggtgtggacaggtgcagggagcaaaacaggtggcaattatagagtggacaggagtgaggagtgtgcacaggtgaagagtggtgtggacgggagtggggagtgtgcacaggtggagagagtggtgtggacgggagtggggagcgtgcacaggtggagagtgtggtgtgtctgggagtggggagtgtgcacaggtggagagtggtgtggacgggagtggggagcgtgcacaggtggagagagtggtgtggacgggagtggggaacgtgcacaggtggagagagtggtgtggctgggagtggggagcgtgcacaggtggagagagtggtgtggctgagagtggggagcgtgcacaggtggagagtgtggtgtggctgggagtggggagcgtgcacaggtggagagagtggtgtggctgggagtggggagcgtgcacaggtggagagtgtggtgtggctgggagtggggagcgtgcacaggtggggagagtggtgtggctgggagtggggagcgtgcacaggtggagaggtgtggctgggagtggggagcgtgcacaggtggagagagtggtgtggctgggagtggggagcgtgcacaggtggagagagtggtgtggctgggagtggggagcgtgcacaggtggagagtgtggtgtggctgggagtggggagcgtgcacaggtggagagtgtggtgtggctggagtggggagcgtgcacaggtggagagagtggtgtggctgggagtggggagcgtgcacaggtggagagagtggtgtggctgggagtggggagcgtgcacaggtggagagtgtggtgtggacgggagtggggagcgtgcacagtctggcattcttgctggtggacaggggaaagcttgtcctctctgtggcaccaagcaccactaccagtcaggattccttgcctggtaaggcactgcccctgcctttctcctgtctggttctcccaccctcacctgggcaggggttcgctgacccgcccttgctggagggagatgatggtcacctggagatcgtggtgtagccagccaggatcccctcctctcacattgccgctgctggctggaaggcatgggcgctctacagttctggagcccttttcctgccctctctgcccgcagatccagcccttcttcagcagctgcctcaatgactgcctcagacactccgcgactgtttcctgcccagaaatgccagacactccaggtaggggacatgcggctgtcctaggccatactgggagaacaagtggctgaaggcccccagcctgtgctgcgtccttacctggttctgaggggtgattagggaggagagtttagtttaacttggagtccttcaggcctgaagtgtggagtggggctttagagtgtcactccctggggctggactcctggctgtctttcattagctatgtagccttaggcaaattacttaatctttttgattctcaacttccttgactggaaaatgaggtggtttttatcctagagccctagttctgtgccatgcactgagcgcagtgctccaacatgccgtccattttttcatcctcactcattgtgagtcacggtactatgcagtagaggatccccccaccccaaaccccaggttcctggataaggaaactgaggcacagagatgttgaataacttgtccaagatcacacagcagggacgctgttttcaaaagtcgcatgccctaatgcacgggaggctgcagccacgtgctcaccagaaggcaaggcgcaggcatggagccaggctggaaggagaacccagcctcccaaggaggaggcaaggtgtctcttcttagaccagcaactcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagacaaggctgaaccgaggccagcccggggtggggggtgagaccatggtttgtcgtggtggggccagagaggacagagcctggggctggggagcagggctgggggcctcagggtgggcagggcaggccccgccgcatcactcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaataccagcaccaccactcactaccaaggcaaatcgctttattctcagagcctcagcttcttgcttgagaaccacgtcataaagctgttgtaaggactgagtgaaataagacacatgaattcttagcacagaacctggcatgtgctatttgcacagtatctgttagccacgattatatttgttgttatcaaatgtagtattattaaaatcaatagtttggaaggagccggagtaaagtttccctgtgtcaggaatgatcatccaggcaggtggagcagcctgaacaaccccatcctgcagccgccagacgtggacgcctggggtcagggagaatagtgagggtcagcatcgggtgatagagaaggctccggctgccctgagccacaggggtggaccccagccccacctcattagccttgtagtcacaggccagttacttaatacaccatggattcacttttctgtaaaatgtactgataatgcctccctctaagggtgtgacgaaggttaaatgagtagctgaggaaggtgcttgctggtggggattagtacataccagtgtcttctcccacctgcagccctctgctggccaagtcctaagccgggagaacacaggccttccggttggggcttcagcccttgcctgccccaccatgaccctaggctgctccttccgtcatctgggaagctgtttccacccttccctaggctcgtcaggattaggtgttaatcattattaattattatgtggtagaaagaaaaccagccaggcatgggaggacctatgggaggttccaataacattcagtagcatctcggccagtgctccacaggcggtgcagctctctaaaggtttggggctgggcggcggcggcgcttttggtttcctttctgctgttgcgcttctgttttccgaagtgtcctgcaccacagggtgaaggcaagaggagcctcgctgttatttggctgtcttgtgacagttctggggaagagctgaaagggttaggattgagattaaggttctaagtcgtttgctcagtcatctgtggatctcaatcctcccagctgtcactaaggagttaacccccgcagagcagttttttcatcacatctctgaggggaacaattgcttaagtatgtgggttccccttcctcacctcaaaaataccaggaggaaatgttgcaagcagcctggtggggctgcttctggaaagaagtgtggtaagatgcatgtcttctgtaaagacacttctggggaagagcttttcctcatgtggagtcagtttggggtggccaaatttcagggagacagggcagaccaggaccgtaatgaggaaccagaatggacaccaccccctgccccccggcactgggggtcccagctggatcagtgctacaaaataactgtgatcccaattgattatgtacaacgtgccaggcacgtcacatacacacactcatttaatacccattaaacaagagcaaatacagacccacctcacagaggaagaagctgcatttcagaggcactagtaactgctccaggtcatagtgctcgtagtggcagacccaggactcatgcctgtgcgaccacctagcacggcctcgctgctcagtctcggggctgcccccttacccttcaccctttgtcagggatggggcagacaccctgtgagctggtttctatttctcttcccaaagaaccactccagtgtatttcttttcctttccagggcctggaagtgaaaaatacagtgatgacaccaaatacaccggtcagtatttcctggtttgcatgtttgcttatttttaaagcagtggagggttctcctgggataagtgcgtgggtcgcctcctgtgctctaactcccaagtcccttcaggagaccccaccttagaaacccccttccagtaccccactcagaagggcccccaataacaaggcctgggtgccattttttgaatcactcagacaaggaaagaaaggtaagtattttgtgaacagaggtcctccctggagcagaccaacagagcttggtgcctctttttcttttcttaattaaagtataggctaaagaccagctaggaacgttgagagattctttttcccacaaggcagcagactgatttttttcaggcagccaaaggtggaatagtaacatctgggtttttccaacaggcctcagttgggtttctcagcttagggagggagccaagctctgtgtcctggtccaggcccctcctgggctggcaggcacagagctgccctgggccctggggtgagggtcagcatgtgtggtcttgtttccttagatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaaaaaaaaaaaagatggtcacgcgggatgtaaacgctgaatgggccaggtgcagtggctcatgcttgtaatcccagcactttgggaaggcgaggcaggtggattgcttgagctcaggagttcaagaccagcctgggcgacatagtgagacctcatctctacctaaatttttttttagtcagtcatggtggcacatgcctgtagtcccagctactcgggaggctgatgccagatgatcacttgagcccaggaggtagaggctgcagtgagctataatggtaccattgcaatccagcctgggcagcagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtggggggtggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaagaaatgtctctctaagaacaggtgccctccacgctgtgcccctcccacctcttcagctcgtctcctgagtgtgcagaggtggttccggttgggaaagaagcagcggagcatctaaccatgcctgtgtccaggccgattatgcacgcagccaccaacaagctcccaactcccgcgtagagtttcatgactttttcctgcctactatcttgatcctagttttttttttgttttttttttttttaaggaataattactttgattcaaaaccagtttctcttttctgcataggaaggtccttgaaggtgtttagggtctaaaaagggtggtgttcggtctctgaaacatccattcagcagtttgagctgggatctctgaatgcaagggtatgatggatatacttctttcttgcttttgttgtgttttggttttttgtttgtttttaagtcagggtctctctgtcaccaggctgtattacagtggtgcaatcatggctcactgcagcctcgacctcccaggctcaagccatctttccacctcagcctgccagtggctagaactacaggcgtgcaccactgtgcccggctaatttgtgtgtatatattttgtagaaatggggtttcaccatgttgtccaggctggtcacgaactcctgggctcaagccatctgcccgcctcatcctcccaaagtgctgggattataggcctgagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgcttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgttacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacgcctgcttagcatttggcacagccagaagcagcaagctagggtcacaacacagagaggggctgtgtaatactggctgcctctgtgctaagaaaaaaaaaaaatcactgtgtgtttgtttattttggtgcaggcccagtgttcttgcttagacttaatactacccttcatgttaaaataaaaccaaacaaaaacccat

SEQ ID NO: 1793 - DNA, 7020 bp, Homo sapiens
  source 1..7020: mol_type = genomic DNA
cttcagtgaagtttatttcagaaccattgaacagtatgatatttgctcatttataaatattcccatttaaataatctgagcttatatattttcagtcttaattaaaggacttgatttaaagagagcacaccagtccaaattgaattgattccatagctattaaaaactaggctcttttacagacactgctacttcttgccccctttgaataaattagaccaatgaataaaacaaacaaacaaataaataaataaatagggaagcggttgctcatcagaatgtgggagcgaatgacagagggtttcttagaaccaaatgtggccgtggtttctgtcaggcgggctttaagtgagtaggagaggtgagagaggcctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctgcagcgaaagagaaagaagaatttttgtggggcaagggacaaagatgctatgggaaagatgttctttgggttggccagaaaggaaactgacgagcaggtcacatgatcaggagccagactcctgagttgtaactgggcccccaactttccgtgtgattattaaaagagcccttcttcttttctaaaacttagtgccaaatgctgaggagcataatgtaggtgagaattttttttttttgggggggtgaaaattaagctagagcttcttgaagtacctagtttccaggggctttttattgtatttttccttatggtcctagaatgacatcaacttggaaatgaagcttttgctgagaaagctggaggtgatagtggtggtaattttgggagtggagtggacatgataatgggaccctttaagtcatctatttcccaaggtgtctatcaaatgagagcagccctaacaatatataatctgttggggttgtaactatggtaggacataataacatcggcaaaatgatttaattttctgcagcaggattgaaggttgcacgcagttaaaaattatgttaaatttatttacattaatgcaaaattgtcaaatagacctgttcccagcttttcctagggatgggggcggggagaaggtggttgtctgggaataagtggtagcaggaggctgagaagggcttcattccatagcattcacttacctccagctgtagagtgggcttatcatctttcaacacgcaggacaggtacagattcttttccttgaggcccaaggccacaggtattttgtcattactttcttctccttgtacaaaggacatggagaacaccactgaagaaagaagggggtcttgtggttagggacacagcagtgcagggtcaccccaacccctaggccccatgagtaggatacatgtaatttggtagcctctgtgggaacccacagtgaggttccttggcctaagacacaggataacttgacttctcacagacaatagcagggtcattttgttgatttagggtttcccctcaaaggcctgagggtttctcagagcctcatagcagtaggaacggagaatgaaagagggtctacattttaaatgctgaaggaaggaaggaaggaagccattgtgtcactggctggcaatgtgcccatccacaggagcggaacaacttgatcaatgtggaaggaaaggaaagaggtgaagctgtacttctgccagaaatcaggcaccagaactgtttcaggaacagagagtagcccatgggaagaaactgggagaggagaggctgagctgggaaagtggctccaaagagagacactcattttgatcttcctcagtcacagcagtgtcaattggaggccctgggatcactcttactacccgattccaaagaaacaggattttcttggcctggctgagagcaaatagcttccccctgagtgaggctgtccttcaaagtcagcagccttagttgcccacactcctgtgcagaggctttggctactgtggcacgatgccaggcagatcaccacagctaatgatgggttcaccgcacttgaaacttttgcccgttacagcggagagatataagttcctgctgggcggtaaaatttccctacaaggaaccacctggcattgggtgggacggatgttggggcaaggggggaagactggggagggggatggacacattatcgctccagcactcttgtttcagcctcaacaacaggaagagagaacccacaggcagttaggccatgtccatcaaatgaccccatattgtggaagaattgacattgcactatgcccaagagacttgggtggacatggtcctgggagtgcttgagccgtctaatttctcagggtcacactcctgttaacaaatgcactggccagtgcaatcaaatgtgccatttctaggaccaaagtttgtatattcctttttaatattttttttcacttgtgttgatcatttgccttaaattaactttctactttgtttaaaacatggagaattagcaagctgccaggaggccaggcagggaaaccaggatgtttccatttaccttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcgaagaagataggttctgaaatgtggagcacatgttgtttaggtataaaatcagaagggcaggcctcgtgaggcgaggcggcaaaatttgatttcttggaggacacctgagcatatacggtcaaagtctgatgacaacaccagtagggatgaagctgggagtggggtggctaagaacactggacctgacactattagacatgggttccagcttcaggtctattactgctcactgtggccgagcaacagagctacttaggtaaaatggtgatggtcataacactagcccacagggaggttacgaacctctggtgacaatgtaagtgaaaggcccctgagaaagagtgagggagttgcaaatgtcagtagccatcaagatcttctttaagaatagtttccactaaagagatgattgctttggtttccagccttctttgttttgtctccccgctgggccttctacctttaaagggctttggctctgggggaattgagttggctggggcttgatgacttccaagaggacacaagtggagatctactgcctgctcttggctaactaccttcttcaaagatgaagggaaagaaggtgctcaggtcattctcctggaaggtctgtgggcagggaaccagcatcttcctcagcttgtccatggccacaacaactgacgcggcctgcctgaagcccttgctgtagtggtggtcggagattcgtagctggatgccgccatccagagggcagaggtccaggtcctggaaggagcactgcggagagagcgagggagggagcctggtgaggtggtcctgccaggaaccatgctttgacatcagagagtagaaagctcagagaggaggaaagggcttgaaagaatcccgagcttctaaagatcatccctctctgggccaggcgtggtggctcatgcctgtaatcccagcactttgggaagccgaggtggatgaatcatttaggtcaggacttcaaaaccagcctggccaacatggcgaaaccccttctctactaaaaatacaaaaattagctgggtgtggtggggtgcacctgtaatcctagctattcaggagactgaggaaggagaatcgcttgaactcaggaggtggaggatgcagtaagccaagattgtaccactgcactccagcctgggcaacagagtgagactctgtctcataaaacaaaacaaaacaaaacaaaacaaaataaaataaaataaaataaaaagattatccctctctgaagctcaaggaggttaagtgtgtactcaagggcacacagcaggttagaggcagactcaagactagaatgtgggctttctgacaccttacaggctattcttttagaataaatcccatttctactttgttcatcttttttgtacatgccccacctacaccatacatgtataccttctctatatctttttgtatccctaatgctgtcacactatgatttgctttttcatgcagatgaccataacattttccattcacctatgctcactcagcaagtattcaatttttctacactgttcttttttttcctttttcataacactgtctcataggcattctgcaaatcctgtgagagtactttttgtgaaatgttaccactttcctcttattcagagaagctccgtattaaggcttcactgaggttgccttaaggcatgataatggttcaaaggcttgaaagacagttaaagagacctgtaagtgcacaaaagaaagttgagcaggagagaatttcctgcctggagcagagccaagctgctggaagaggcaatgggggcaaaggccaggcagacaagccaatgggctcctcccacagctgcagccaacaagttatgccagtcttaaaacttctaaagaaatatgtttttaacaagattgaggactggattatgaggctaggggaggctatcacaaactggaataaaataaagccagagaaaagtggctgcctcccaacctgcacaactgacctagctaggctgatggctgggccacctaggaaggctactgagcatcatataaaacagaagggacagcaggaatataacatggctctttgtaaggatgagtctgaaaaatgaccatttgctgcccaaatgcccttagctacaactgaaaatatttcagaactggaggttgcaggatgctggaatctcagagatcatccagctcagccctttatttttcagatgaggtccaaagcgggtaaaatgacttgtcaaggtcaaacagcaagtgaatggttttctttcaagtctcaattcatctttttgtttatatcatctatgtcttgttgttataagcttcaccccaggtagcaaaaaactattctactcaaaaggggtagacatatgttagttctcaagatcatctcttggtttcagagtttaactcaagtgattggcataggctgaatccatctcttaaaaggataatcaaatttatgttgaagacttggttgtcttcctactatgaaatgggaaacattatcactactcctcccctgtcaccaccaagtgtggccaccaccaccaacgttagtgagtgactgtggtgatatgatgaccaagtggccaggtcagcaagtggtgcagcctgtgtctcactggaagaggttaaagtctttctaaaacaaaataccatggcatcaaagtggcccagaactcccttctttgagctttccctgtgttagagcccttccttgggttgggagttaaacccatagtcttaccttcatctgtttagggccatcagcttcaaagaacaagtcatcctcattgccactgtaataaaaacagggacatgtctcaattatgtcttctaaacaggtttatttttccttccctgtgtacaagacttgactgttcataagaaactgcaaacagcctgcctctcaaagctgcctgaaacacctggcaagtttcacagtgatatgcgcagaacagtccagaaggcagattctaggcctggcaggtgggcaccctgggtgctccctgttggatcttgaggcctaacctctagcccagcagagtcagctaaaatctgagctctccctctccctccaagccacactttgcaaagggattccttgtattgtgggcttggagtcttttctccccatttgcctctgcaggaagcccttgcaacaacacatctggatagcctccaggtcccaaggctggagggacttgtaatgggaaagtagtctttaaatcagatttacttggcaccctgtttgccactgaaagaggcaatttaggggaaaaatctggtctccaagcacagataacactctactcttgaaagaggagacctgctcatgttactggtctcagcgtctccactgacctgtaataagccatcatttcactggcgagctcaggtacttctgccatggctgcttcagacacctgtgtaaaaaggagaaaatgagtgacttccccatgacggctacgttcatgtgtgatttctctcagcatccagtgcatggcagtcatgcaaagaaatgatctctgagtaaatgaatgaatgtgtgaaagagaagtcctttgggtctagagaaaagcatttgctaaaccaaaccccaactagcaatgtattggctaggagagctggagcagaggctttgacactaacctttagggtgtcagctgttagataagcagtatccattcccagaatatttcccgagtcataagcattatattacacctggcatttttgcaaaaagctgagagagggaggcagagagggaaggagagggagagacagagaaagaaagagagagagagagagaatatgcatacacacaaagaggcagagagacagagagactcccttagcacctagttgtaaggaagattaaagtcatacttgagcaatgaagattggctgaagagaatcccagagcagcctgttgtgccttgtgcctcgaagaggtttggt

SEQ ID NO: 1794 - DNA, 8430 bp, Homo sapiens
  source 1..8430: mol_type = genomic DNA
ctcctccacttggaatacaaagaaatgactttcactactatattagagtatgtaacatagtgtccaactgcaagttagatcctcaggaatcttcacttccgtgtgttctagaggacagatgctgatgaatcatctgtggaaatagtataccgtgagtaactaagaagcaaatctggataggtaaagataaagcagaaaatcaaatgaaacttaaggtagataccttttggagaagtgatttgaatctttctaggaattctttgggtggttttttctcataagaatcacatgaagggcatgtctagaaatcaatgaaaaagtaacagtcttctttaaaatttttttcgtaataaaatgtttcttaaaattttttttcattaaaaacataaattatgttcactgaaaaacattcgagaagtacataaaactgtttggaaagtaacaatggaaaaagtccttgtaatcccattcccagagataggaatcccactgcaatgttttaatgtatattctctctgtgttttgggtatttttaattattattgtgcatttacattatttataccagttggtgatttgctttttttttttcacacttaacatatcacaggatttcctaagtgttaaataatcttcaaaaatatgacatgtagtggttgttctgtattccaacataggatgcaactcttactatttttggacccaaaggttgcatctaactttttttttttttttttttttttggagacagtcttgctgtgtcacccaggctggagtgcagtggcgcgatctccactgactgcaacttccacctcctggattcaagcaattatcctgccttagcctcccaagtagctgggattacaggcacgcacgaccatgcctggctaatttttgtatttttagtagagaccaggtttcaccatgttggccaggctggcctcaaactcctgatctcaggtgatccgcctgcctcggcctcccaaagtgctgggaatacaggcatgagccaccacacccagctgtatctaactttttatttttgtctacattactccaaagaacatctctgtaaataatttttcatatatatctttgcttatttgatatattcctagaagtagaattactaaattaaagggataaaaattttaaggctttgatatacattataaagggttttacctcttttcacttggagcattcttattattatagggtattgtttaaaatgtttaattggaaaaaacaggatttccttgttttaactcgcatttatgtgattactagggagattgaacagtttttcatatatggattgctcacttagatttttaaaaagctttcttagtttatgctctttgtctttatccctatttagataccaaacaccaagccattgcttggtagttagcatctcaatgccagtgtgatgttgtagtgagagcatttcactaaaagatagtagatatacgttctaattctcattctgacactatttatggaacttggggctagtgacttaactcctttgtagatctcactttcctcatctataagatgaacatgcttaactggagagttctaagtttagctccaaagctaccacttcatgagtttcaaaaatatgttcagctcctttctttctgaggaaagatttagagggatatttttcacatggtcaccaggccaagcaatcaaaagaaataagaataattttgataatataattaagatttcatttgaatcacatgtggaatgtttttggaggcaaaagaactaatttaaaaaatttgaggctgggtgcgatggctaacacctgtaatcccagcactttgggaggccgaggcgggcagatcacccgaggtcaggagttcgagaccagcctgaccaacatggtgaaaccccggcactactaaaaatacaaaaattagccaggcgtgatggtgtgcgcctgtagttccagctacttgggaggctgaggcaggagaattgcttgaactgggaggtggaagctgcagtgagccaagaccttgccactgcactccagcatgggcgacagactgagactctgtctcaaaaaaaaaaattttttttgagagtaatttattttatgtattttcccactggctttaatctttgaattactcatgttcttgggtatctgcattgctcatgagttggcatatacaagaggatctcagggctcctaaaagcttgggactgttaaaattccccagccaagtaatgaggcctccctatttcaattcaatactgactctgctgatgtacaggatagtaatatgatttaagagaggaggcaaagtttaagatttgccctagtcttcttgtaggctcttttcttgttagaaagctaggatctagctcctgttaataagaatacaagttatctgtgaccatatgagaggaaatagttcttaactccaaaatcacagttggattctctgcctaatgacttcctcaccttgagaagctatattaacatattccagctgccaaggactactaggaaattataattgggtttttgaatactttcaagtctgtgggcttaaaagagtgaccctacttcttaaaatgcaccacgtataggccgggtgcggtggctcatgcctgtaatccccacactttgggaggccaaggcgggcggatcacggggtcaggagatcgagaccatcctggctaacatggtgaaaccctgtctttactaaaaatacaaaaacaaaattagccgggcatggtggcgggcacctgtagtcccaggtactcaggaggctgaggtaggaggagaatggcgtgaaaccgggaggtggatcttgcggtgagcagagatcacgccactgcactccagcctgggtgacagagtgagactctgtcttaaaaaaaaaaaaaaaagcaccatgtataataaggcataactataggtaaggaagacaccagcagccctggctacaggtgtgtgtgtatgtttatgtaatgcaagatatatagtttataagtacaaataagagagatgacaaatgacaatcttactagtctgtgtttctgtcttctccctgcatttgtggaaggtggtttcctcttcagctttttaattgatacattgattatcctttcattgtttcctgtatttgctgactttagttgggccttctgaaagcaggaaaaagctgaccactcacagtttgtctgaaagataaacaatttgtatatatgttaacaaacattattcagaaagtaaaagatagctttcccaatcctctatttctatctcttctgcaatgtcgtgcattacatcgtttcaacagatgagtgaggtatgatttcacctcctacttaatctttgggatgggaaaaagggacaatcccctgcttcgcagataagagagaaaggagcctcacttcttcacaatgctttattcctgatgctacacagaggaccattttgatgtctgggtggtggacaagacctttgtgttttataaaggagagttagttcggtttaggacacatttgctgagttatgaggctctaaaacttacactgtgactagtggcagctttgggtaaattatgttatagtctgatgaagaacatttttcatttgtttgtggtttctgttaatgtatctatcatgacatgtcttgagcagcattttattctgtacagcgccaggcatagtgtcttgccagttaatgatcaacatatatttgtaaagttaacagatgaagaaaatgaattaaagcccctcctttggagaaaggaagtgggtacctccctctgatagcatattttacatctaagattcaatatacttgccatagatcacacatgacttttctaaaacccttttcatactcccagctcagttagggttaggattctgcctgaatcaagcagttgaggaacagtttgaggcttgtccaaccaatgagacggaaagtcatttcttagaaggtaagaatagggtctcagagaatggaggagcggataaaataagcatcaaacacttatctcttggtttggaaaaatagctaatgactaacaagccaaaagcttagccatcaaactggaaaggaaatggaatttactggaaaaaccaaacatatactgacttgttgaaaaattttaatgctgatccaaaagcttatatccaggtgacttgtatccaacttacttttttctttcagcaaacgtgtgtatgtgatgctattttccccctgaagttgctatattttcatttcactatgcatatggaagctactaccttataaccagaagcctcaatccctcccagtccctacaaaggcaggcctatacgtaacaatattacctgaatcttcttatggacaatcagctgaacacagcatctggcctgctttgcattttccaacccatatgcttacccaatatgaatgtagattaataatatgcatctctaagacacaaacctatcaggtttgctttgcatatatagccacaagccgagaagcagcttatctggtttccttatatcaaggcagattgcctctcataagggcaaggtggtgtcctttccatatgtttgccaaaatgcttatttaatagaaactatttataaatgttcaatatagcacttttttttccttgaaaaccacacgttcatgtttgttgaagttttttcttttctcttctttttgaccacaaccggcttaacttactggaaaaaataatattcatatttaaagaggtaaattttccagctgaaactgaaaatactgactgcttcatccgtgatgatctgaaaaaccagcatttctcacagaggctcattttgctgagttaacatttacatgtgtatgctgaaagaaaattaggttccaaagaagtagaggggccctgccagccaaatgaactcccttgagataatattgccaggaatggtcagtaccggtactcaaagcactgaaattgtaaaactacaatttcagttgtaaaaacaactgaaaatcttttctgaaagcctttgaatggtacctggacactgacgcccatattgatggggctgtgcttcctctcccacccttccttgtttacctctgttaacagacaatggggttttgttttcttctgttctgcaagcagcagagctgtgtctggcaatatgtggtccaggataaataactgcgggaattggctttatatgcacatcaaaggcagcctcaaaagaggaaaagaagtagagggctgtcgccactaaactgccttaaggatgtattgagaaggagagtgaaaagattaaccttgatttaggcagcctcaggtgccctatcactcaggagtctacaggatgccaactccatatttagcactgtctggaagcatgaacattgctttcctttgctatgccttggtgacaacagactccaaaggcaagactttgtttccctcatgctttaacatatgagaacatgaggagttttctgctgctacattgttttgcagactagaaggagcggtagtaaagtcaaacgcaagaattaacaaaccattcctcttcagctgaagaacaagtcaagtgctgcttttgccaggagtcacacttggctttgttgttttgcaattgaatttttgaaattttttacctccttagggcttttttttttttcttttgtagaaacaggatgtctcactattttgcccaggttgttctcaaactcttgacctcaagcaatcctccaaacttggcttcccaaaaggattacaggcattgggattacaggcaggagccacttcacccagctgaggcctatttttacatttttttccttttgcaaagaaagccctggccattcacactaagaagtcttgctaattgggcaagactacctttgtcctggctgggtgcagtggctcacgcctgtcatcccagcactttgggaggccaaggcaggtggatcacggggtcaagagattgagaccatcctggccaacatggtgaaaccccgtctctactaaaaaatacaaaaattagctgggtgtggtggcgtgcgcctgtagtcccagctactcgggaggctgaggcaggagaatcgcttgaacctgggaggcagaggttgcagtgagctgagatcgcaccactgcactccagcctagcaacatatcgagactccgtctcaaaaaaaaaaaaaaaaaaaaaaaaaaaggattacctttgtcctacacacaaactaggtttatatcagggtttctcaacggtgataccactgacatttggggctagataattctttgttgtcagggctgtcttgtgcattctagaatgtttagtacctggcttctacctactagatgccagtagcacccccattctacctccaagtgtgacaaccagaaatttttccagccaatgccaaatgttttctggggcacaaaaatcaccaccggttgagaaccactggttatatgattagacggaaagaaaaagagaaaaagaaagatgcctggctaggccaattagagatcttagataattactatatgcatgcaacattagatagttttattttcattaaacttttaaatcttttaaaatctcttacagaccctactttgaagctagcttgatataatgctaatgtgaccttgaacgatttctttcttcctgagtttgcctactagtatagcttaaagatccaagttacactattactcacttatatcatagccagcattgcttgatcagattatcagatagatacagtatcacggagacaaaatcctttcattatgatgtaagataaaaaatatctttcattaacaacacacgtaaaggaagtacccactggaccaactcaggttagaaggtggaatctctttcttatttcttattttgcaagttatagactacagccaggaaactctggaaagaactctaaccataacagttaaacaaggtgcatgagatgctagaaatgtatgttttgataattaggcacattgattaagaagtattttcagttattggaaaagtctttccaataagctgaatgtgctactttcattttagatgctgcttattagaaaaggacctagtaaatgagagtgtttgggttcagagctagagagtgaattttagagaaaagcaatagttgtgactcattcactttctaaacttttacacatagtcatttacgataattgttttctttgcaatgtatcttcttaagtctccccctttgtagtgtcctaattactggtagcacttttagttattctaatttatgcaattaaaggtctgtgacaatgaaaacatttccccaattgcatttatactctcagggtaccagaccagaagatcagatcgtagaagttactggagaaaaagatcagcggacagcactcttgaactacatgccaggcctcttcttcctggaactctaatggatttaaatggcttaagagacgggatgaattgttgaaaatggttctttcaaaagacctcacggaaggccaaagacaagactcactgaggccaaggtatatgtgaattatattctgaaggacagctttgatttccacaccaccatttctccatgctgtccctgtaatctaattctttctttctttcttttttaagtttgttattaaaaggttaattctgcttcctactgtatgtatctatgtttcttcggtaggataacaaagaaggctcaaaagctttcatgcccaagggctcttaaagagtaactagctgtgcattgttcagaaactgatcagagtatagatttcgtttctagttttgttattctgtctcagcaatactacttaggagtactcttagagattcttgaagataaacatagtttatgaggaatataatatagcattttttagttggtttttggtaaatcaatgaatttaaccaaaatataaataaatatttcatcaattattagaccgctaagttcattaaaattcagtatactcctatataatcatgctaatgtctttcttattggatttaaaaacttatgtccaatgtattttcagaaataaattcaactggtcttacctctacatcttctggagctggcagaaattcagggacctagagcaaaagaaaatttgttctgagttatttttataagccaaaccctccttttatattaattgaaaagtatgatttagattttgttgtgacaaatatagtcttaccaagtcattcacataatttttcagctgatcaacaatatctataagttgacgcattctaatcatgtggcgatcttgaccttgggagcttgatttgtggaccagtgtccccaagaagatgaccatcagacagatgacaatcctctccatgttgccaggactggatctcataagtaccaacagtagagctagaccttggtctcgttttcacttcagc

SEQ ID NO: 1795 - DNA, 8430 bp, Homo sapiens; identical to SEQ ID NO: 1794
  source 1..8430: mol_type = genomic DNA

SEQ ID NO: 1796 - DNA, 49881 bp, Homo sapiens
  source 1..49881: mol_type = genomic DNA
ctcttcctccccactctgcacatgcggctgggtggcagccagcggcctcagacagacccactggcgtctctctgctgagtgaccgtaagctcggcgtctggccctctgcctgcctctccctgagtgtggctgacagccacgcagctgtgtctgtctgtctgcggcccgtgcatccctgctgcggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggtaattccagccctggttttctgctgggaccagggtgccttctctgcccaggagggactgttccctgcctgctgcatctagtgtcacagtgggagggctcggaggactgtgcccaagtcacaattggggacactgaggcaaagaagattcatgcagtgaggctgggcagaaatgaggttggggtctcttgttcagcacagcttaggggcccagcagcagggatgtggctgagacgaccctctatcttgaaaaccagcctccaaaatgtagcgggctggggaaggaaagccagtttcaagccaaacataacatgtcaatcacccgattctgggcggctgagtcgggaggtgacgggcatgggtgtagagcctgatgggacccattctgtgtcagtttctatgtcttaccaccttgattccacccagtcattcaaaacaatggctggtgtgcccatttcgcagatgaggcaatgaggctgcgagaggtagagtgattttccctcggtgactcaactgggacgtagcaggtcgggcagtcaagccaggtgaccccatgagctgtcgctgcatctttctcatgaagcacggggaacgggtcggatggtaagaggccaacccagttccctgtgcatgtggaggagaggagggtggggaggtcagtggaggctgagccttgaaggatgggaaaggaagaacattcctggtggaggagccctggggagcgggaacttaggacttgccgcaggaatgacgtctctgctcagtgaaggcagaagaccaggtgcgggacattcaaagccaggaggctgctgcgaggaggacatctgtgattccctggggggagagtggggctttcagaagcacatggtggagtcggggaaaacctgccaggtcaaaacccggccacgcgccttcctcactcggtgaacttgggcaagtctctctgcttctagccttgagaagccatggttttctcatctatgaaatggggaccaaggtacccccatcctggtggagctagttgtggggacctcagggccgaacagggtgaaagctgtgctcctaatggcccttttcctttgaggaagagagtttgtggcatgagaagctttgagcccatggagacgggcccgactccaagagtgacagagggggagcgacacactcaggctgctgtggtcctgcctggccagccacctggctctggcccccccagtgccaactcaccatgttgtaggcacttaagcgtctcccatagtcctcaacaggtgaagcgggcagcctcattcagcccatttcacagatgacaagagtgaggcttagtggggacaaccttgccccaggttaactgtgaccagatgacatggagctgggattggatgccagtctgtaggacaaggccaccacctgctagatagaataacatgaaaacaagactcatgggcttgggtagcttctgggaagcagcattggatggggatggcggagtattcattcccacgaggacaggcaacccccagaggagaggccctgctcacctgctccccaccgtgggctcagcgatgcccctgtcctgcccgctcctctgccaggagggtgtccggatccttactcagtcccacagtggaggtagctaaaagcccttgtgataggaggaggcagaatccaggaccaggagaggtggggagagcaaggcaaagacagctctgagctcagactgcaggctcccactgcccagcgttcctggtttcaggctaggagaagaaactgggaggtggggattagagccagtaaggggcttgtgggcagtagagtagggggtggataccagaggaggaggcccattcaagagaaagccagccaccagaagttctgggaggaacccacctctttgtagcatcaggacaacccaggtgcctgataaataaatgaatgaaaggaacggggtatccgttccttccacagccagagagggaagctagcgccttcagcatcctcacaggcaggcacaggggccttctccacacaactaggaaggggtgcctgcggttagatgggggaactggaactggcttcccagcacaccaccccttgtgactttgagctgtggaactggccagacctgggttcaagtccaccgcttagtacctgtgtgaccttgaggaagccacctaacctttctgcagctcagttgctgcatctgtaagagtggaaataggaataagaatgcctgtcttaggtctgtggtgaggatttactcaacctattcttcatggaacatctaccatggcccaggcacctccctaggtcctgaagctctggggtacacagagagagccagtgtgatggggaaggcaaaagagctgggcacagatggctcatgagaagtgcccgctatcatgttttacttttttttttttttaatttttttttgagacagagtcttgctctgttgcccaggctggagtgcggtggcgcaatctcaactcactgcaaccttcatctcccaggttcaagcgattctcctgcctcagcctcccgagtagctgggactacaggcacctgccaccacacctggctaatttttgtatttttagtggaggcggggtttcaccatgttggccaggctggtcttgaactcctgggctcaagtgatctgcctgtctcagtctcccaaagtgctgggattatagacatgagccaccgtgaccggcctatgttttactttaaatatgtaagagctctttgcttttagctatgaaaatacagaaaaaaaataataaatattattggtcatattggcatatatgagacctcagtaaataagagctcttatgatgattctgcttccccccttttacagatggggaaactgaagttcagagcagggtgggggtttttctagggtcactcagggaaccgtctagaagggagcagtgaaaagaggggaacagatgcttcctccaggaagagggtcttcttgccctcgcagccccttcctcacatgccctccttccctgccctccggagcccccggacacgtgaaggggagggagagggggcaatgggaggaacccacccccacccctggctcacaggtgccaccgcccccactccctgccctggccccaggccaaagggacttttcatgacagctcaaatgagacctctgagtaaacttggaacttctgaaacgacctgagaatattccccaggctggggggcaggggccacaaggagggcccccgactgcccaggacatctgcatcaggaacccagcctgctgatctctgcagcccacaggaaggatctggccaccccgacccctgccctgaattgtccccggggagttggggcaagtgcaccagcccgggtcctagcccaggcccctgccatcccccactgtgtgaacaggacaaggccctgggcctctctgggcctcctttccccatctgccaagcgggcttgactaggacgagggcttgccaactttccccagaatgaatcagtaacaccagtccactttggccagggccagggcgggctgatgggggctgctgggaactgaggggagagagacggtgggtggccagctccgctccatctcgtggcatagttcaaagcctcctttcactgctctacaagcggcccctcctgggctggaggaaatggagctggagtgagatctggctgcagaggctgagagattgcaaggtttgggcaaggctgcagaggatggcagggcttgcagggagatagagattgcacaggcagcgggggtggggagtggggggtgcgggtgctgggactgggacctcatgctccacagctaggagaggttgcacaggctggaagaagtgccaggagggaaagattgctggagctaatagagatttgctgcctggctaggagagagagataggctgagaggtcgcacagcctcagaggttgcacgagctggggaggagaaggcccttcctctcaccttcgtcttctactgattaactgtaagcctgaggtccccaacatacctgccttcagacacccataacccaccccttgccactggcgaaaaaaaaaaagatgaaaagcaactaacactaaccacacacctaatactaaccacactaacctgcctcacactccgcatccaggctaagcctgctgcccccattccacagatgaggaaagctgaggctcaaagaaaggcagagatacggccaagttcccactgtgagtgaatggcagagtctgctttctgacccagggccactgggctagttcttccccagcctgagaacccactgagatgagaacttgctgtgtgaccctgggcagcccactgtccttctctgaaagttccttgttactaatctgatgacattagtcatgattattcacactctggaagcagaagatgttgcctgaggtgggtctggggggagtttctggggacagtgaggaagctaatgaggaaagcaggacctcttaggggctgtctccatttttagcctcattcattcattcacttaacattcttcttcagctacttatggggcacctacaggtccccttctctgcactagggatactgtgctgaacaaaataggtcaattacccagcctctgagagctcatgcttcagtacagaaacaagttacaaacacatacacagagacatttacaaaacgattcctcatcttacacctgctatgaaggagacaaactaggggatgtgggctacagagatctgtggcgtagacccagttcagatagggttgcctctttgaagaggcaacactgaacttgaaacctgaggatgagaaaggaaagaagctgggggaaaagcattctaggcagagggaaaggcatgtccaaaggccctgatgcaggaaaaaaagattgaagcattaaagcttttatcctcggccaggtgcggtggctcatgcctgtaatcccagtattttgggaggccaaggagggtggatcacctgaggtcaggagtttgagatcagcctgaccaacatggtgaaaccctgtctctactaaaaatacaaagttagccaagcttggtagcccatgcctgtaatcccagctacttgggaggctgaggcaggagactcacttgaacccgggaggcggaggttgcagtgagccaagatcgtgccactgcactccagcatgggcaacagagcaagactccatctcaaaaacaaaacaaaacaaacaacaacaaaaaacgtatcctcaccaaatacataaggctctcaatcccctaaagctccagaaaaatgggtcaaaaagggtaagatttaactttggagtgtacggtctacataggtcttaacattgaggataatgtttgttcacaattcgtttccatagaaagcattctctttcatttagtcactcatgtagcaaatgttttgagcacccactgtaggcactggttagttactggggattcagcagtaacaaagaaacacactgtccctgcctagatggtgcccagaatatagatgaaaacaccatgagctatgtactatgtggagggtggaccccagaggaaggagtgactcatgctctttggagaggtcaaagattgacagaggagctgccatttgaatgggattttgaagactgagtaggaggctaacagtcagtcaaaaagggcagatagtttccgtggctaaaacagcacatgcacaggtgtgcaagccaggtgaatggagcatgttggtgaggctgtcagtggtctgatgagcctgaagtccagtatgaatactgggggctagatcccgaaatgccttgaataccagacaaggaatttggggtttttcttttgtggataacagagagccatggaatgacacggttggagtaagaatggagttggaggaaccacagctctgtagctatagcaggaaggtcagagaggaggaccagcaggagagcaggtgggcagaagtccttgaagaccctggataactttaggagttctttcttctgtgttccctctcgggaagtccctccgccttaacacttcctcttctggtgacctgttggctcctgttcctggcacttctggggagtccctcttcgcccacctcatttctttgtgatccctataggaaatagggccattttacttttaccacactacccacctttcactttcagccccatgtccctacctgggtcacattgcagagaatggccgacttgaggaactagacgcatcccattcctcaatcgtgtgacagaaaaaagatacagggaaaccaagaacttgggttctttccagtgtggggaggttgtaaataatggctgctatgaacatgctggtacatgtctgcttgggcacatatgcttgcatttctctttggttatataacttggaagtggaaatgttgagtctctgctcagcagaagttttccaaagtggttgtgtcgatttacactcttaccagaatattgagtagagacagagagtttagttactctgtatccttttcagcacttggaattgtgtttatttctctctctctccatatatatatttataaaaataaattatatatgtttattatatataatttatattttataaatatatataatatttataaataaatatttttatatttatattttattataaatttacatatatatataattctttccctcttcctctttcagtttcttttccattctcttaatggaaacttttgatcaataaaaaatcttaattttcatgaagtttatttataaatctttctttatgaccagaactttctatgtgctgtttaagaagtgttgcctgcaataaagtgataaaaatattattctgtgttttcttctagacgatttactgttttacctttcacatttaggtctacagtctatctgtagtttatttttctgtatggtgtaaggtaggggtcaaggtttactttttccatatgaatattcaattaatataccatcatttaagaaaacatgttttctctccactgccttgcactggtgacttactgaaaatcaagtggttgaatacatgagtttatttctactgtttctgttcttttccattggttagtttgtttttccttgcaacaatgccatactttctaaattactttataaatcttgacattcttcttcaaaattgtctaaactattttcagtcctttgtatttctatataaattttagaactatcttgtcaatttccaccaaagaaaatcttgctggagatttttttcttgaaactttggattttactgaaactttacttcaatttgggggggactagcatccttaaagtattaaattttccaatccatgaacatagtatgtaccaccacttatttatgttttctctaatttttcttagtaatgtcttgtaggtttctgtgtagaagtcttgtacatcaactaggtgcagtggctgacacctgtaatcccagcactttgggaggccaaggtgggtggatcttttgaggtcaggagttcgagaccagcctggccaatgtggtgaaaccctgtctccactaaaaatacaaaaattagctgagtgtggtggtgcatgcttgtaatcccagctactcaggaggctgaggcagaattgcttgaacccaggaggcggaggttgcagtgagcagagactgtgcctctagtgacagagctgagtgacagagcaagactccatctcaaaaaaaaaaaaaaagtcttgtacatctttcattagatttcttctcggatatttgattttttgatgctgatgtaaatggcataattttaaaatttcttgactgtttgtagtgtacagaaatataatgagtttttatactttacaactttattaacactttttaaagctaaagttccagatgttaaaagaaatagctatcaaacccagcccacttcaactgaccaccagttgagggcttcctgcctttctttgcttttgtaatgtttatggatcctttcctttgctaatctaacaagagagggtattgtagtgcaaagtatagtgtcccgggtttggattttattaaccagtagatcttttttacccttaacaatttttagatgtgcagtacaatattgtaaactgtatgcacattggtttacaagagatctctagaactttttcctattgcatgggtgaaactctatacccattgaaaaacaacttttcatttctccctcccccagtccctggcaatcagcattccactttctgtttctatgagattgattactttacatacatcatataagtgatacaatgcagtatttgtttttttgcaattggtttatttcactttgcagaatgtcctcaagaagcatccatgtcgtaacatatgacaggacttcctcctttttaaagtctgaataatattccattatgtatgtactacattttctttatccattcacctatcaataaatttaggttacttgctcatcttagctattgtaaataatgctgcagaaacaggtgtgcaaatatctctttgagatgctgtttttatttcttttggatatatgtctggtatttctatttttttaattaaaaaaattttttaaagtttcgcatcattttacaatcccactaaaagtgcacaagggtttcaattctctacatcttcaccaccatttgttcttttctttttttttataataaccatcctaacaagtgcaagatgatatctcattgtagttttaatttgtatttccctgatgattagtgatattgagcatcttttcgtatgcttaatgggcatttgctgatcttctttggggaaatgtctattcatgtcctttgtccttttttttttttttttttttttttttgagacagagtcttgctctgttgcccaggctggagtgcagtggtgtgatcttggctcactgcaacctccgcctcccaggttcaagcaattctcctgcctcagcctcctgagtaactggaattacaggtgcctgccaccatgcctggctaatttttgtatttgttagtagagatgggatttcgccatcttggccaggctggtcttgaactcctgacctcaggtgattcgcccgcctcggcctcccaaaatgctgggattacaggtgtgagccaccacacccggccatttttaaattgagttatttgtttttgtgttgttattgagttgtaggagttctttgtatattctagatattaaccccatatctcttgtatggtttgcaaatattttgtcccattccataggttgccttttgattccgttgattatttcctctgctgaacagaagttttaaagtttgatgtagtctcatatgtctatttttacttttgttgcctgtgcttttgttatcacacacaagaaatcattgcccattccaatttcacgaagattttcccatatgttttcttctaggagttttatagtttcaggtcttatgtttgggtctttaacccattttgagttaatgtttgcatatggagtaaaataaggatccaacatcattcttttgcatatggatatttggttcttccagcactatctccttgaacaaacttccttttccctcttgtatagacttagtgcctttgtagatcatttgactatatacacaagggtttatttctgggctctctattcttttccattggtctgtatatctatctgtatgccagtaccatactatattgattactgtagctttttaatacattttgaaatcaggaaatgtgaggcctccagctttcttctccttctccttctccttctccttcttcttcttctttttttttttagagtgttcttctttctcaagattattttggctatttagggtcccttgaagttccatatgaattttaggatgaattctttttttatttctgcaaaaactgtcattgagattttgatagggtttatattaaattcagttttctgtgagtagtattgtcatcttaacaatattaagtcttccaatccatgatcatgggatgtcttttcacttatctgtgttctttaatttccttcaaaaatgttttatacaagtctttctcctccttggctaagtttattcctaagtacttttctctttttgatgctattgtaaatgaaattttttgcttaagtttctttttggattgtccattgttaatgtaaaaaatgcaactgagttttgagtgttgactttgtatcctgcaactttgcttaattcatgtattagttctaaccatttttttaatatttagggtttcctacatataaaatcacgtaatctgtgaacagagataattgcatttcttcctttccaatttagataccttttatttctttttcttacctaattgctctggctagaacttccagttgaatagaaatggcaagtgtgggcatccatgccttgttcctgatcttagaggaaaaggtttcagttttttactgttgaatatattcactgtgggctttttatatataaactttgttatgttgaggtaatttatttctatttctagttccttgaatgttttctttatcatgaaagagtattgaattttttcaaatactttttctgcatcaggtgagatgaccatgtgatttttgtccttctttgtgttaatttcatgtattacatttatctgatttttgtaactatccttgaattctgcagataaatcctacttggtcatggtgtatagccttttaatgtgttgttaaatttggtttgctagcattttgttgaggatttttgcatcagtattcatcaagagtactggtctatggttttgttttcttgcatctttgtctggctttggtactggggcatcataaaatgagtttggaagtgttccctactgttcaatttttggaagtgttagggatgaattggtgttgattctttaagtatttggtagcattctctagtgaagccatttggtcttggccttttttttttttttctaggaggttttcgattactgattcaatctcctttctagtttaggtctgcttagattttctattttgtcatgatcagtatgggtaggttgtatatgtctaggaatttactaatttatttgaagtatccaattcgttggcatataattgttcatagtagtctcttagaatcctttttatctctgtgacatagttacaatgtctcctctttcatttctgattttagttaatttgagtcttctctctttttttcttagtttaactaagggtttgtcaattttgctgattgttagaaacacaatagatttttatattgatctcatcttcagcttctttgaataataataacaattattattctaatagtttatttgttgagtatcgtggacttttctggttcctcaattcttatataacttaaacacatagttttctaatctttataaattaaaagtttcttatcattgccttattatgttaattagcacctctagtataagatgtttttgtttttgccctgacctcagtaaggaagtgttcaatatttcacaattaaggataatgttagctatgtatagtgtgtgtgtgtgtgtgtgtgtgtgatcgtaattagattaaagaagactcctctatttctgctttcctgacaggttttaaaaatcatgaatgggtgttgcaatttattaaatgtgctttctgaacttattaaatgataatataaattttcttgtttattgagttaatgtggtgaaattgattatggtttctaaatgtcatactaaccttacattcctgaaataaaccaatgtgataataatatgttatccatttttataaatattattagatttgacttgttaatattttgtttcagatattttttagattatttatgggaaagattgacctgtaattctactttcctttaatgtcaagttttggtattaagactgccttttatttcagacatcaatgaaagcactgatgtgtctgggattatgtctaccatcttgctatttgttttcttttttgacctatctattcttccttctttgttctagtttttagaaaatcaagttttaaaaattattattccatttttcctattagtttgttcattgtactttcttttatattctttttgtgcttatcttagagattacaacatgcatacttattattattaggatctacctaatatgaattcttccaaaagttcatggaaaattcaaattatgaaaaaactatgcataaagttcaaacttttttctgcaccaaaataaacttgtactaacttgctataacatgtctgaacaggatctagtttgaggcactaagaaggataaggcgtctgtttgcaaaaaagcccctatcattgcaacatgaattctgctaaaattgaagcaggaacaaacatcaaatttatggtgcaactagggtggaaggatggcgaaatcaatgataaagataaagccctccgtggccgatcatccatatcaatttgttaggaaaaaattcatcttgttcatgccctaattgaagaggaccaactattaacagcccaaacaatagccaacaccatagacatctcaattagttcaggttacacaattctgaccaaaaaattaaagttgggcaaacttcccacttactgggtgccaaaccactgtgcccagatcagctgcagacaacagcagaaacttccatgcaaattttaaactaataggatcaagattcagaagcatttcctcacataattgtaacaggagattaaacgtggctttaccagttcatcctgaagacaaagcagtggctccaaagaggtagacgaggttcagtcaagacaaaagcagaccggtcaagaaaagcaaaggtcatggcaaccggtttttgggatgctcaaggcattttgcttgttgactttctggacagccaaagaatgataacatctgcttatcatgagagtgttttggggaaattagccaaagctttagcagaaaaacgcgcaggaaagcttcaccagagagtcctccaccatagcaatgctcctgctcattcttctcatcaaataagggcaattttacagcttccatgagaaattaggcatccaccttaaagtcctgtttggctccttctgacttctttttgtctcctaatcttaagcaatctttaacgatcacccatttttctttagttaataatgtaaaaaagcctgcattgacatggctatattcccaggaccccccagttctttggagatggactatgtgcctggtatcatcacttacaaaagtgccttgaccttgactgaatttatgttgagaaatagagtttattttttaattgttatctttaattccatgtttccatgagctttttgaagtcctcttgtacaatttgaagtcctcttgtacaaagtcctctttaactttattcacctcttcttacctttggggtttcatggtcgtgtattttaattctgcatatagtttacatcattagtatgttaagaaattaaaaatcatagtaattcacttatttatttatttattttgatacagagtctcactttctcacccaggctggagtctcactttctcacccaggctggagttgcagctcactgcaagctccaccttccggattcaagcgattctcctgcctctgcctccctagtagcctacactacaggtttgcgccaccacacctggctaattttttgtgtttttagtagagactgggtcttgccatgttgtccaggctgatctcgaactcctgacctcaggtcatccacccacctaggcctcccagagtgctgggattacaggcgtgaaccaccgcacccagcctaattcatatatttagagtactttctgttgctcttcatttcaccctacagtaacttgcttcccatctggaattatttttcttttacctgaaaaactcactgttgtatatctcttgatgcaggtctatcagtgacaaaatctcttacttatttttgtctgaaaaaaaatccttattttgccttcattttcaaaaatctgtatttcagatgtaattcacaaaactgaaaatgtactcttaagatgtgcaattcaacaaagttgtgcagtcatcaccactaactctatattttcatcactccaaaaacaaacctacatccattgctgttactctctatcccccctcccctcagcctcagctcctggcaaccactaacctactttctgtctctatggatctgccaatgctggacatttcatacatatggagtcatacaatatgaggccttttgtgtctggtgtctttactttagcatgaatttttaaagttcatccattttgtagcacgtatcagtagttcattcccttatatggctaaataacattctactgcatggatatactacatttctttatccattcaccagtcgatagaaattttgcttgtttccagttttttggtattatgaataatgttgctgtgaatatttgtctacaatggtttgtacatttctttctggacatatatccgcaattgttttctttcctttttctttcttttttcttttcttttttttttttttttgagacagggtcacactctgtcacccaggctggactgcaatggtgtgaaaacagctcactgtagcctcaaactcttgggctcatgtgatcctcccaccttagcctcctgagtagctggggccacaggtacataccaccatgcccagaaaatgttttcattttaatttttgtagagatgaggtcttgccatgttacccaggctagtctcaaactcctgggctcaagcaaccctcccgccttggcctcccagtatgctgggattacaggcatgagctactgcatctggtcaattcttttcactatataactaggtgtgaaatttcttggtcatatggaaacagtcatacattgcttaatgacgaggatacattctgagaaatgtgtcattaggtaattttgtcattgtgtgaacgtcatagagtgcacttacacaaacctaggtggtatagcctactacacacctaggctgtatcttacagcctataattggctacaaacctgcacagcatgatacggtactgaatactgtaggcaactgtaacacaattgtaagtatttgtgtatctaaacatagaaaaggtacagtgaaaacataatataaaatatgaaaaaacggcacacctgtgtagggcacttaccatgaatgcagtttgcaggattcgaagttgctctgggtgtcagtgattaagtgctgagggaatgtgaaggcccaggacattgctgtacactcctgtaaactttatcaacactgaactcttaggctactctaaatttatttgaatttttaaaataataaattaactttggcttactgtaacatttttcctattttatttattttattttattttattttattttattttattttattttattttattttatttatgttattttattttatttaagacggaggttcgctctatcgcccaggctggagtgcagtggcgtgatctcggctcactgcaagctccgcctcccgggttcacgccattctcctgcctcagcctcccaagtagctgggactacaggcgcctgccactgcgcccggctaattttttgtatttttagtagagatggggtttcacgtgctaaccaggatggtctcgatctcctgaccttgtgatctgcccgtctcgcccttccaaagcgctgggattacaggcgtaagctaccgcgcccggccctattttatttcattttttgagacagagtctcactctatcacccaggctggagtgcagtgtcgcgatctcagctcactgcaacctccgcctcccaggttcaggcaattctcctgtctcagcctccagagtagctgggactacaggtgcgcgccaccacgctcggctaatttttttggtatttttagtagagacggggtttcaccatgttagccaggatagtcttgatcacctgacctcgtgatctgcccgccttggcctcccaaagtgctgggattacaggcatgagccgctgcgccccgccaacattttttctttataaacattttaactttttaaaactttttgaataacacttttgtaataacagttatcttattgtaataacacttaagtgttttcgtgcactcttgtactaacacttaagacacaaacacattgtacagctatacaaaatatttttctttatattcttattctaaaagcctttttatatattatattttaaaattttttattttttatttttttacttaaaaaaatttttttttgttaaaacctaagacacgcggggcatggtggctcatgcccgtaatcccggcactttgggaggccaaggagggcggatcgcctgcaatcaggaattcgagaccagcctggccaacatggtgaaagccccatctctactaaaaatacaaaattggccaagcatggtggcgggcgcctgtaatcccagctacttgggaggctgagacaggagaatcacttgaacccgggaaaaccaacaccacgccattgcactccagcctaggcaacaagagcaaaactccatctcaaaaaaacccagaaaacaaaaaacaaaaaatctaagacacaggcagacacattagcctaggcctacacagggtcaagatcaccaatatgactgtcttccacctccacattttgtcccactggaaggtcttcagtggcaaaaacacacatggagctggcatctcctatgataatgatgccttcttccggaatccatcctgaaggacctgcctgaggctgttttacaagttaacattttttgtttgtttttaagagtcttgctctgtcacccaggctggagtgcagtggcacaatcttggctcactgcagcctccacctcctgggttcatgcgattcttgtgcctcagtctcacgaatagctggaattacaagcacacaccaccgtgcctggctaatttttgtatttttagtagagatggggtttcaccatgttggccaggctggtttccaactcctgacctcaagtgatctgcctgcctcagcctcccaaagtgctgggattacaggcgtaagccactgtgcccctccaacatttttttttaagtaagtacaaggagcacaccctaaaatagtgatttaagatatagtatagtaaatacatacaccagtaacatagtttattattattattattattattattattattattatcaagcattatgtacaatacataattgtatatgctatcttttttttttttttttgagacggagtctcactctgttgtccaggctggagtgcagtggcgcaatctcggctcactgctacctctgcctccccattcaagtgattctcctgcctcggcctcctgagtagctgggactacaggcatgtgtcaccacgcctggctaagttttttgtgtttttagttgaaacggggtttcaccatgtttgtcacactggtcttgaagtcctgacctcaaatgatctgcctgccttggcctcccaaagtgctgggattacaggcgtgagccaccgcacctagccctgcatatgctatacttttatatgactggcagtgcagtaaatttgtttccaccagcatcatcacaagcccatgagtaaagtgttgtgtcatgacgtcactagacaataggaattattcaccttcattatagtcctatgggcccgcctatgtacatgcagtctgtcattgaatgaaatatcattatgcagcacgtgactgtatttaacattttgaagaactgcaaaactgttttccacagtggctgcaccattttacattctcaccctccgccccctcattcacacttgtgattgattattattattaccatcctaatgcatgtgaagtggtatctcattatgttcttgatttgcatctctctagagagtaatgtcaatggccaccttttcatgtgtttgttgtttggatatcttctttggagaaatgtctatccaaatcttttgcccattttaaattttaattcttgccttttagatcttgagttgcaagaattctttgcatattctaaataccagacctttaacaaatacgtgatttgcaaatgctttttttcccatgctgtatgttatagttttactttcttgatagtattttttgaagcacaaacattttaaattttgatacagtttaatagatctattttttctttgtttacttatgcttttgtgtcatatttaaaaaactattattgtctcatacaaggtcatgaagatttacacctaggtttattctaagagtttaatagttttactttttacatctagtctttaatctattttgagtaaatttttgtatacggtgtgaagtagaaatctagcttcattatattgcattgtggatatccatttgtgtggtaccatttgttttaaagactattctttcccccattgaattgttttggcaccctcatcaagaatcggttaaacataaatatatgcacttctttctgaactctcagttcaatcccattgatctatatgtacatctatgtgtcagtaccacagtgttgataagtgtagctttgtagtaagctttgaaataaggaagtttgactcctccaactgtgttctttctcaaaacctttttggctattctagtcccttacatttccctataaattttaggactagtttgtcaatttctgcaaaaaaaaaaaaaaaaaaaaaaagagccagctgggattttttatagagattactttgaatctgtagatcaatttgaggcgtcatcttgataacattaagttttccaatctatgaacatggtatatcctccatttatttaggttttctataatttatttcaataacatttgtaggttttattgcacaagtctcacactaataaacaaattcatctcatattaacataactaatgaattttgttaaatttactttaaccattttgttctgttttgtattattgtaaatgaaatcactttcttaatttcatcttcagattatttattgccagtgtgtataaaatatcattatttgtgtctattaatcttatattctacaactaggctaaatttgtttattagctctaattggtttttgttcgttttaggtgtaaattcctttagttttgtatatacaagatcatattatctgcaaagagaaatggtttacttcttcctttccaatctgaaagtcttttatttcttttccttacctaattgccttggctagaacctctagtaaaatgttttataaaagtcacaagagtgaacatacttgtcttgttcatgatcttaggagcaaagctttcatttctttaccattaagtatgatgttaactgtaatatttttatagctgtctgtatcatattgaccttacttttattttttaagagatttttttctggatataaaattctaaattggcttttgaaatttcagcattgaaagaagttgttccattgtctgctgtcttccatcattttgttaaaaagtcccctgccagtcttattgtttcttccttgaaggtgaagtgtcttttttttctgcatactgcatatctttgtcttttattttttaaaatagtttttctatgatatgcctagatgtggttttctttgtatttatcctatttgtggtttgtagagctatttaaatctgtggcttaatgtcttttgttagtttggaaaaaaattttaagatcactgctatttcttcttacttgttttctctctcttctgcttcttaattgcaaatgcatgtatgttagatcatttcacaatgtcttctatgtctcttttgctcttttctgtatttttgaactttttttctctgcatgcttcaatcttggtattttctattgaccaatcttccagtttactaatcctctcttctgatgttactagtatgttgccaaatccatctcttcagtccttataaacttcagttattatatttttcagttccaggatttctactttttaaataggttccaaatttctgatagaatttttgaacacattaatcatagttattttaaatcatatctgataatgccattttccaattcacctaagtaacttttctattgtctattttatcttcattgttgatcatttgatactgcttgttggtttaccttgtaattttaactgaaagttggacattatgtataaaaagtatagaggctttggatgaagctaactttttctagatcaatttaaattttcttctagcagacatatagcatataagcagattacaccttgatgcagtcaagaatgaactatttctaatttttccttattcccaaggaatagtattttctaaatagctgggtactcaccagggcccatcttttttttgccaggccctgaactctaattcttccctcagcttgtaaaactgtgaaaattccttcttagttttcccacctattagcaggtgtttttttgctaagtttcttggcatgctacttattttcaatgactttgcacatgatttgaggggaaattgcatgcagaatttcaatgcatttttcctctcttaagtactatataagttggcactctcttgtgcagtttttttttttctgcttagtagttgccctcagtgggaggattagtgtgacaacagctacttcattatagccagaagtggaagtccctcatccatattttattttacaaaactaagcctcacttacatttaaaatggtatgaaatagtttgaacatacaaaagggcataaaatataatcaacacccatggtagcttcaccaagctttaccaaactgttgagacccttgaacattcctccttctcacaccccctccttttccacactattcaaaatttgatgttattatccccatgaatttttaaatatttttatgatgggtgtgcttacctaaacaatatataggatgattttgtatggttttcagtgtggtgtcaatggtgttattatgcttatgctgttctctaacttccttttttcactccaaattttgtttgtgagagtcattcactttgttgtgtgtggctgtaaatgattcatgtttacactgagtgacagtattgcgatttattttttcactctcctgatgatggctatttagattgtttccaatttttcactattaaaatcaatgctgctatagacatgcaggaagaatttctttaccagtttacataagagtgaagttactgggttttaggtagggcatgtgttcgcttttattaggtcatgccaaactttttaccagaccagttgtaataatttacatttcctctggctataaatgagagttcctattatatcatatcctgagcaatatgtgatgtcatcagactttcagtttttgccaatccgacaaaattaaaatggtatgtcattgtggtttttctttgtatttcttttctcttctttttcttttttttgagatggagtctcgctctgtcacccaggctggagtgcagtggtgcaatctcggctcactgcaacctccacctcccgggttcaagcaattctcctgcctcagcctccagagtagctgggattacaggtgcccaccaccacacctggctaatttttgtatttttagtagagatgggtttcaccatgttggccaggctggtctcgaactcctgacctcaggtgatccacccacctcggcctcccaaagtattgggattacaggcatgagccaccacgttgaccatgaagttaagcaccttatattctccatagcactcacttcaatctaatttcctgccccaagcttctccatttccccagaatctcttgaaatttggtcaacttttagggtgaattacagcaactccaggaaacatttctcagcactgaaactggtggataaatgcacctacaggacttcaaattcgatgacacttttaatgctcatgacaaacctgcagcaaagattgatgacctccattttatggatgagaaaacagagaatcagaggggttagagaacttgcccaaagacgcacagctgggacctggcacactccaagtcaggtgcacttcactcctccgtaggagactgcagaggttgggtgctgcagcggtgtgtcaggccattcttgcattgccataaagcaatacctgagactgggtaatttataaagaaaagaggtttaattggctcatggttctgcaggctgtacaagcatactgccagcatcttctcggcttctggtaaggaggccctcagggagcctttactcaaggctgaaggtgaagcagaagcagacacatcacatagcgacagctggagcaaaagggggaggcgccacgcacttctgaacaattagatctcaggtgaactcactcatcaccaagcggatggcactaagccattcatgagaaatccgcccccatgatccaatcacctcccaccaggccccacctccaacattggggatgacatttcaacatgagatttgggtgggacaaatatccaaaccatatcaaggggctcctgtagcaggaagcctcctaagacaccttctgtccttgtaggaaacacacatggtggcccgatctgtatctgaggataaggtgctgttgccctcaggggtcagcctgcgtgcaaagacccaaaaggggatggattcggggcagagaaggcagtggaattagggtaggccccatttggtgctgtgggagcatgaggagggagtgatggagaaagtctgtgtttttaagctgatgtttcccagaagtgagcagtttattttaaacagtgttaaatatccctggatcccctagtgaaagcgtaggctctttcatcacttgccctgctgatggaggaggcaagattctcaatttggtgctatcgcatcttaaacactactctctctttttttgtgttttgttttgtttttttttgagacagagtgtcttgctctgttgcccaggctggagtacagtggtgtaatctctgctcactgcaacctccgcctcttcctgggttcaagcaattctcctgtctcagcctcctgagtagctgggattataggcacacaccatcacacccggctaatttttgtatttttagtagagatggggtttcgccgtgttggccaggctggtctcgaactcctgacctcaaatgatcctcccacctcggcctcccaaagtgctgggattacaggcatgacccagtgtgcccggcctccctttcttaactttaaacaaagacaaaccacatctccagtttctaggactctcaggcaggcagtagcatgtcactaaaattcaattactgcctttgtttttcttgtatttagtttttatgttgtattgtatttagttttatggtaagttgattgttttgtttaagtaacacttatataatatctgctatatgccaggcactgttctaaatgctttataaatgttgactaatttaattctcccaaagacctatgaggcaggtgctgtgattatcattactcccattttacagatgaggcccagaaaggttaagcaaactgcccaaggccacaaagcctataagtggcagagctgggatttgaactgagaccagccagctccatagtctgtgtcttgaccagcatggcgcacactgcctatttcatgccagttatctgctgatggtcatgatataatatttttgagacatgtttattggagtaaaaaataggaggcaaggtaaagatcaatagtaagtggataattaatagtagcaccagtgaaaacctcaaacgcaataggctagtggcaggagttctggaacactccagtgtggctgcagggatacagcacatggaccatgaaagttgagttgagaggatgggaggggaaaggtgttggagggcaggagtctgctccagcagaggcaaagatgcatgacgaagcctgggctgccggggagacgatgagtaattcagggcagtcagccagtaatggcaggaaacccgtgcactggtacagcacttcacagtccgtgaagcactaccacatctgctttctcacagcctcttcttcactgccaggtgcagtgagcactattgtccccatttcagagatggtaactgagttcagagaataaaagagccagagaagagctactatttgcttcaagatcttctggcttcaaattctgagcccttttctcaactccactgtgtcagggatctttggtggcaagtgacagaaatagaattcaacatgattaagcaacataggtggtttttggctcatgggaatgagaaatccacagggtggacatcagatatggctggatccaggacctcccatgatgccatggggactcctgacctgtatttctcagtatggctgtcattttcaaggaggctgtctctaagaggtgacaaagatggctacaagctctgagaagataccaaaaaaagtgtcagttttctagagttctagaaaaaaaatctcaggactgctttcactggccttgcctgggttgacatccatccctgatgcaatcactgtggtcagacagatggggtgttttgattggccaagcctgggtcaggagcccactttgtggagcatggggtggagtcagcctcaggcaaaccactagaggcagctcagatagaggagctctttgggaagagacgccgggcaggcagaagcagcaggtaccccctccacatccctagggctctgtgatgtaggcagaggtaagaaattaggagggatgaggagttttttgtttgtctgtttgtttttttaaagacagggtctcactctttcattcaggctggagtgcaatagtgcaatcatggctcactgcagcctggacctccggcactcaagtgatcctccttcctcagtctcccgaatagctgggaccacaggcacacagcacccggctaacttatttttacttctatttttatttttggtagagacaaggtcttgctatgttggtcaagctggagatgaggaatattgaatctgggcaaaggagtttgcactttttgctgtgctgtggtcaagataaaaccatcagggagtgacggggacagagctatgtcaggactcgcaccgtggctggggtgatggatgtggacagaatagtgagggggcagacacagactccccctcctgcgatcagaggccacatcttcaaagtgtgataacaggacctctgcaggggttggaatcacacaggattcatattcctaaaagcaggttgaaactgcatctacctcaacattattttatttgagtagtgatgttattgcttaggatgatgctggagttaaatttttaagtgtgcttatctatagaaaatatattaaaatatgtattaaaataaacaacagtgcacacaatatacaaatatggccaaaattttggatatgagatattttggcaactcttggctagatcattctgagaccccctctgtttctgaggctctaccttctccatcaattacagctgttgtttgagtgtttatgtgatgggggccatctgcagggttttatgcaaatcacctccttgaattctcacaagcctggaagcaggccttgctgtttccactttacaaggctcagagagggcaagggactggcccggagccacacagctggtcatctgaaccttcctggccccccagcctgtgccctgccccagggttctttgatggctctgtgagggaggtcagagggaactatggatggggccagagtaggatctttgggaaccccggcacagaggaggaggatcttccccttgtggagtcagggatggcgtctggagaaagccatgcctgtgacttgggtcctgcatggggcatccctcttaggtttagctttagctccattcttgtctataggggctggtctgggaggggctcctgagtctgggcaggtggaccactgccctctggctggcacttcctcaaacagacacagagctggtgggtgaaacagacaagtcccaggagaagcctggcatcgccagactggtggggcattcctctgcccaagacagtagagggcactctttctggataaactcactctgctccccaaagaggttccttctccatcctggcccaaattaggaggtcaggttgtctctgtttggtcaggcctggatttcctagcatgctcccgagtgggctaatctgggctttgtgatggagtaaggagcctcattattgggctaaccttatcttaagtattcagcagtggttaactttgtgggttaactttggatttattattcagtaagaagccaatttattgatggctgggtgcagtggctcatgcctgtaattccagcactttgagaggctgaggtgggtggatcacctgtggccaggagttcgagaccagcctagtccacatggcaaaaccctgtctctactaaaaatacaaaaattagccaggcgtggtggcggccacctgtattcccagctacttgggaagctgaggcaggagaatcgcttgaacctgggaggtagaggttgcagtgagccaagatcgggccactgcactccagcctgggcgatagagtgagactttgtctaaaaaataaacataaaaaagccaatttactggcttttttttacaacatggatgtttataggaaggaagatccaaaattgctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtgactcatgcctgtcatcccagcactttgagaggccgaggtaggaggatcatgtgatcccaggagtttgagaccagcctgggcaacatagcaagatgccgtctctacaaaaatgttttaaaaattagccaggcgtggtggcacgtgcctttggtcccagctactcgggaggctgatgcaggaggatcgcttgagcccaggaggttgaggctgcagtgagccgtgattgcgccattgcactccagcctgggcaacagaacatgaccccatctctaaaaatattaaaataaaataataaaacaaattcactttgcatttgtgacgtgatggggcgggggcaggaagaaggtgggagaagggattcttggggtgaatctgccatttctaagaggtgggagttcttggggtcatccacaggcccctcgggatcttgcatttttcttaagacagttccaagaatcaggggcaagtctgcctgggaagagacaggatgagggggaggccgggggagccctgagcccgcctggctcaccctccactgtacgtctcttgcaggcccgtgggagtcagcatgccgcgtggctgggccgcccccttgctcctgctgctgctccagggaggtaagtggctgccccgtggtctgcgggtggggagggcccccatcacagagctgagccagggccgggctggctttctgggctcaaaaacacggctagagtccacagattcagaaaagatgacatccatgcccttgaggctgacacgagtccagtagccggctctccactaatcagaatccatccaccaaagggctccatgaaacagaagcggtagacatgagtctcaggtggcccagcccacaggcttgtgtcttcgggtgtcactggggggatgaaaggcttcgtccttcatttcccctgacctctgccttggctggctcccaactctctgagtgaggaagttctgccttccatctaacctcagtttctccttatgtaatgactctccttggaaatgtttttcaacaattgctgcaccgggtgcggtggctcctactggaatcccagccctttgggaggctgaggagggtaggtcgcttgagctcaggatctcaagaccagcctgggcaacatggtgaagccctgtctctacaaaagaaaaaaaattagccaggcataggagcgcatgcttgtagtctcagctttttgtggggctgaggcgggaggattgcttgagcctgggaggtggaggttacagtgagtcaaggtgacaactgtactccagcctgggcaacagagcgagaccctgtctcaaaacaacagcaacaacaacaacaataaacaaacaaaaaaatcgctagattcttagcaggcactggtggtccctgggctggggacaggaggaagagccaaaaggagactgaaccttggtaggcagcccccagaggaccagatgttgtggttagagggggtgacgttagaaagcagaactgggaagaccaggagtccgactgaaagggcactgcctaggactaagagatcctggagggcttcctggaggagggggccatgaggaggcgggatccagcacagacttgtgtggaggccggcctaggggcaggggaggaactcaacagctgctctgctgactcatgggcatttttctctggtttttaccagaagacccaggacctcaaatagctccttcaggaaacagatgtcaagctttgattttccctttctgagtggcaagcatcctcatcttggttctaaaaagcctttgggtcacccaccatggctccacatctggcgggtgcagataacaagccctggctgcatgcaaagctcggagcgtcatcccattccactgtcccaacagccccacaaggcgcatgttgtaatgacgcccagttttttggctgaggaggctcagagaggctaagagacaggtgcatggccacactacccggaagaggcagagctgggatcagtttgctcttggggtctgtcttagtctgtctgtgctgctgtaactgaatacgtgagactgggtaatttataaataatagacatttactgctcgcagttctggaggctgggaagtccaagatcaaggcaccagcagtagctttgattccggtgaggggcccatctttgctttttttttttgagactgagccttgctttctcacacaggctggagtgcaatggtgcaatcttggctcactgcaacctctgcctcccaggttcaagcaattctcatgcctcagcctcccgagcagctgggataacaggcacatgccatggctaattttcgtatttttagtagagttggggtttcaccatgttggccaggatggtcttgaactcctgacctcaaatgatccacccgcctcggcctcccaaaagtgctgggattaccgcacccagcccccatctttgcctttaagatgccacattgaacgctgcaccacccccagaggggacacacgctgcatcctcacatggcagaagggcaaaaagggtctgaatgttgggttcgtccagccctcttatagcatcaataattcattcaggggggctctgcccccatgacttaatcatctcctagagtccccaccttttaatatgatcacattggcaactgagtttctggggagacacagacgtcaaaccgtagcacggccttcaccatgctgtgctgctatctgtggagtgatagccatgtgcgggcagcatgcaggcacaggcatgatctcatctcaacacctcaacagcctctagggcaagcagtgtctccggcttacacatggggaggagaagcagttttgagtcacatgtttgcagtcacagagctactttgtgcacctctcactgcctcctgcacgctttcataaccccagacatgggatggccctggggctctctgccctgtggctggggtactgacagggcattttcccaccctctcatccctggtgccacctccctgccactcaggggctgccgttgcctccccaagtttggagacaaaccctgtcccttggtagctttgagcctggctaggaatggtagctcctctccaaattcccagagctctgagaaagaaccacgaggatacgaactcagagatgacacagctacttagaggctctgtgttgaggttttgccaaaatcagtcctgttttctccaccaagtgctggaactagctccttttcactccaccgacaagttctgtgtgtctccctgaggaaagccccctcctagagcaagatttacttccatgactcagatcccttggtagccactgcctcgagagaagttgagaagcattccgaggtcacacctaggggagggagtgctgtgatccattagcaatatctgtcatgtgtgcggctatgaaaaactagcacagactaggtatttccttccctgggtgagtgtctcagcagcccagaccaagagagacaagaggcatggtctagtcttggagcctcagtgttctcatctctacaatgaactaaaggatatttccagacacagtattcttggctccgcatataggttctgtcctagagtgagacccaggaagggaatctaccaccaccacctcaggggtcttcattagtccagggaaaataggaaaaagccaccaaaaatgaacctacttaaaaaggggaacaaggtcaggcacgatggctcattcttacaatcccagcactttgggaggctgaggcaggtggatcgcttgagctcaggagattgagaccagcctgggcaacatggtgaaaccctgtctctacaaaaacacaaaaattatccaggcatggtggtgcacaactgtagtctcagctactcaggaagttgaagtgggaggactgcttgagcccaggaggtggaggctgcagtgagctgagatcgcaccactgcattccagcctgggcaacagagcaagagatcctatctcaaaaagaggtgagcggtacaagtttctagtaaatagcagcaaaaaatagtggaattggcactcgaatatacaaaacaaagctacaaattattccattgattttgtccacatttaacaaaatgtagatgatgattgcacccctgttttagaacacagcgaaacaattaatgtttggggagcaggatggaaaggtgttaaatcttccaacaaaattgcctcatagggcaatacctagaagacttcttggtggcggtggcatttttggccgcaggatcacgcagacctttatgcaaaagtgtccgagggctttttaattctctcacggtttcctactccttgaagcacttcctgaatctccgagagtgggtgtcctgtggatccaacttctgtagagccgagtcctcttccttgtcagggttttgggacattttcagcatagctgtccttgactctatgaggtcctgaccctcttggggtgtgtgcgtgtgctctggctgggttcctaccacatctggggcatttaggatattgccattctgagtgggagcttggccaggagggacacagacctggtggccgggcgcagggctctggaggagggtgctgagctggggaccagctagttttatattatttgccatcacatgcatcctgtcttcatagccagccttgaaacattggtgctcaaacaaggaatttccaggtggtgaggccccctgggtgccaggcctacatctaagcagctcctgagtcctcatatttgtcccggcctggggacccctgcacccattcttcctccagccctcgaggggatggagaggaagctctgcagtcccaagccaccccccaccaaggcctctctccccactgaccctccaggctggggctgccccgacctcgtctgctacaccgattacctccagacggtcatctgcatcctggaaatgtggaacctccaccccagcacgctcacccttacctggtaagtagccgggcctcaccagtccccggggatgcaattcagggtgcctgctcagtgattcccccaggaggacactgtgcactgaggaccactgtgtccgcctttcagacaaccactcagggctcacaggacttgaaaagtcaggagcccgcagggttggtctatccaccagcttcaaaggccactctctcacccacacaggtcggccatggttttgagaccccgggatggctggtttcccgcatgatttttcaagcacttaggtaccaggcccccaactacacgcttcccatgaatggtcacccccaaccctcacaatgattactcccattttacagatgaggacattgaggttcagagaggttaagcaacttgcctaaggtcacacagccagtgaatgctggagctgggattcaaattcagaccgcccaactccaaagtccatgggtcccttttagaccctatgcagctcaggataaagaagagcttctgttatccatcagctcattcattcattcaaaaccatttataggccaggtgcagtggctcatgtttctaaccccagcactttgggaggccaaggaaggaggatcacttgagcccaggagtttgagaccagcctgggcaacatcacaaaaccctgtctctacaaaaaataaatcagtcgggcgtggtggcacaatcctgtaatcccagctacttgagagtctaaggcagggggaccaagctcaggaggtcgaggctgcagtgagctatgatcacgccactgcactccagcctgggcaaaaaagcaagatcccaactcaaaaacaaaacaaaacaaaacaaaacatgtattaagttcctgccagacactgttgcaggcactggggattcagcagagcaagactgaccaggccccagatgccttggaactgacgtaccacggtggggcggaggctgggggagacagacacacaaaacaaccaacaaggtgctttctcttttttattttattttattttattttattttatttttttgagacagggtcttgctctgttgcccaggctggagtgcagtggtgggatcagaactcactgtagccttgacctcctgggctcaagcaatccctccacctaagcctcctgagtagctgggactacaggcatgcatcaccatacctggataatttttgtagtttttgtaaagacagggttttgccatgttacccaggctggattcaaactcctgggctcaagcaatctgcccacctcagcctcccaaagtgctgggattacaggtgtgagccaccatgccaggcccaaacaggacactttctttctttcttttttttggagacggagtctcactctgttgcccaggctggagtgcggtggcatgatctcggctcactgcaacctccacctcctgggttcaagcaattctcctgcctcaacctcccaagtatctgggattgcatccaggtgtgcaccaccatgcctggctaatttttgtattttaagtagagacagggttttgtcatgttagcccacctggtctcgaactcctggcctcaagtgatccgcccactgtacccgcctttcagacaaccactcagggctcacaggacttgaaaagtcaggagcccgcagggttggtctatccaccagcttcaaagaccactctctcgcccacacaggtcgcccatggttttgagaccccgggatggccggtctgccgcatggccagcctcccaaagtgttgggattacaggcataagccaccgtgttctgccccaaacaggatactttctaataatactgggtgctatatcaaggacagaacactggacctcaggtaaagggaccacaactgctagtgagaaggaggaagccagggagctgggcagagggcactgccagtgcaaaggccctgtgggagaagagctggtgcgtttgaggaatagggaggaggtcagtgtggctggagtggagtgaggcagggtgagggggaataaggagcaagttcaggctgggaggcttggagagcatttattcagcaggaacttgtattccagcaaatttggcagagaactcagtccacacatccctactgggcctagagagtggtcatgttcagatcctgaacatctaggtagggaaattaatatccggtaaactactatacatacttcaaaacccatcatttttgtccagtgggagttaaaaagccacagcattttccctaatcccatcccaccaactttcccagaagtccacccagaggaggagatgaggttcatttagctcttttcctggccctcagcacaggctattattagatattcagtggatttggggactgggcgaggtggctcagtcctgtaatcccagcactttgggaggccaaggctggcagatcacttgagcccaggagtttgagaccagcctaagcaacatggtgggaccccatctctacaaaaaatacaaaaagttagctgggcatggtggtgcatgcatgtagtcccaggtactgaggaggctgaggtgggaggatcagctgagcctgggaaggtcgaggctgcagtaagccatgatcacactactatactccagcctggggccagagtgagaccctgtctcaaaaaaatggatgttggacagaaaggagagaaggaaacccaaaatgcctagcgcccttcctgcaggacagccatctggttgttgggaccaacagggacagatttaggcttagtccaagcaagaatggcccaaatttccaaaattgagagctgctgccctaaatgaggtagtgagttcctggcccctgggaggtgtgcaagctgagcccggacacaattcattgaggatgctgtaggggaggtgataccttccctgggaaaaggttggttggaccaggtgaccaccccccagccctgcctcaaatccctcccagccctgagagtctgggcttctgccctggccctgagcactgagcccaccaccatcccccctgcccctggcttccagccatgaccggctgctttgtccttgaaggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcagtgagtatcctgggaccccaggcttagggtggcactcaatcttagctcaccgcagccctgacctctctgggctcaggtgatcctcccacctcagcctcccgtgtagctgggacaacaggtgtacaccactacacccagctaatttttgtatttttagtagagacggggatcttgccatgttgcccaggccagtctcgaactcctgggctccagcgatccacttgccttggcctcccaaagtgctaggattataggtaggggctgggtcccctactccctgccctctgggccagctctcctccttccatcagatctgacctggcctatgtcctcactacaccttagagttctgttttgagttgcgctattttttactaaagtgtgaaaggttgataataggtttgagaggtattgaaggagctaggctgggacccgggacttctgggttcgtgttccggctcagctctgcccatctgtgtgaccatggatgaggcatacctacctctgggacagcttccctatttgtagagcaaatgtccttttaaccctgactttctgggatcctgaccccataatgaggcgaatggacgacactgagttacagaaaaaaaaaaccctcttgggttttttccccttcataagctccagggaggcctggaatttccctccaggctggaggtagaggggggtcccaggggcaggagggcctggttggtgggagcagttttatctgtgagttcagaattagggcaggtggcagggcgaggtggctcatgcctgtaattccaacactttggaaggctgaggcaggaggattgcttgaacctggggctttaagaccaacctgggcaatatagcgagacctcatctcaaaacacaaaacaagaaccagggcaggggccaggcactgtggctcacgcctctaatcccagcactttgggaagctgaggcaggtggatcgtttgaggtcaggtgttcgagaccagcctgggcaacatggtgaaaccccatctctactaaaaatacaaaaaaatttgccgggcgtggtggcacacgcccgtaatcccggctactcgggaggctgaggcaggagaattgtttgaacctgggagacagaggttgcaatgagccaagatcatgccaccgcactccagcctgggcgtcagagtgagactccgtctcaaacaaaacaaaacagaactaggcagggcatggaagggcctgggaggtggctttggcatggtgtgtgtgtgtgtgtgtgtgtgtgtatgtgtgtacccaaagcggccccagaggcaaacacaggctgcaaagggagcctgccctcaggaaggccccgcccatgagctcgggagtttctgccgctagattcccagcagaggggctggggtataagaggtgtctgtgattcacactctgggggtccaggtttgcacctctttgctgagtggatgtcacaccacagagcgtgagagtgaagcttcacacactcccagacacatgcacactcacgcaaattcccagggtcacagactcacgcacacacagactcatagatgcgccctcaaactcacagatgtctccccagccccagcctgcatggcatggacacagaggcccacactgcctctctctcttgctctctctcactctcatacacactcacacatacatacacacacacacacacacacacgtacacaatacacacacactcacacatatactctcacatcactcatacatgggcacacacacgcacacactcacacatgcattctcacacacgtgtagactcacacatgcacacacatatacactttctcacacgtgtgcacacacgcacatatacacatactcatacactctcacatcacacacgggcacacatatgcacacactcacacatgcattctcacacacgtgtacactcatgcacagacacacacattactcacgggcacacatgcacacactcacacatgcacagactcacaaggggaccctccttgccacttgtcttgcagcgtgaatccaagcatttctctctggcattccctccctccctgccaggatctgcagctagcctggtcccagctggggcaggaagtgattttctaaccacctcccgccgagggtcccttcctcctcctgggccctgggcctcgctgggctgagcagcccctcttcacgacccccaggctctgcaaacatctcccgagtacccacggggcagttctcagtaccctggtgtcttctgggactcatcctcacccagccacacagggaagccgagagccggcctccacctgccccggggaagacaaaagaggggttagaaacgatttcagtcaaaaacatcccattactggaacagcaacagcaacaacccagtgttcaccatggcattctgtaaaatgtgcacctctgtcacctcggggcgtggtgggagccctcagtgcgggtttcaggatcacaggcagccttagagctcctttctggaggccttgcaaggttcattagttaatctgacaaatatatatatatatatatatatatatagagagagagagagagagagagagagagagagcgagcaagcgcgcgccagggtgtagctttgtcctccagcctggggtgcagtggcacaaccatagctcattgcagcctggaactcctgggctcaagcgatcctcccacttcggcctcctgagtggttgggactacaggtgcacatcaccatcctggctaatttttaaattttttgtagagctgggatcttgctgtgttgtccaggctggtcttgaacacctggcctcaagcaatcctcccacctcagcctcccaaagtgctgagatttttggcatgagccaccttgcccagcctaatttgccaaatatttattgagggcctactgtgccccaggctgtgttctaggagctgtgggcacagactgaacctggaggacaaaacctctgccccaaggagctaagagcccagtgagggaggcacatagtaaacaaaatcacagggtgagaggtgcagagtgttagatggtggcagattgaaagtgaagaaggtggctgggtgtggtggctcacacctgtagtcccagcactttgggaggttgaggtgggtggatcacttgaggtcagaagatcaagaccagtctggccaacatggggaaactacttctctactaaaaatacaaaaattagccagtcatggtggtgcgcacctatggtcccagctacttgggaggctgaggccgtgtaatcgcttgggcttgggaggtggagactgcagtgagctgagatcacgccactgcactccagcctgggtgacagagattctgtctcaaaaaaaaaaaaaaaaaaaagaaagaagagaaaaaagaaagggagggagggagggaaggagggagaaaggaaggaaggaaggagaacaaaaaaagaaaaagtggagaaggtgagggcagaggcctgcaactcctctctgacactaatagacacttgtcactcagttcctctgaagttactgccttctgctaaatagcttcatccctttgaacttgaagccccatgatataggaactgagcccattttacaagagaggaatttaaggcccttaacatattgtgttctgctcaagttcatgaaatgtccttcgaatggagcaaaaacagaatgccggctttgaccttcacctggaggccgcccatgaaagcttgctgttatggctcagagctcggctcttgcacttgccaggagacgctgaaagatgaggaccatcagattggcctcccagggccactgtggggtgtcaaactgcccagagcagggcagccaggcaggctctgtgtaaatggcagccctcaccattagcattcatgctaagaagagtcatcaactgcttgaagtagctggggttgaaagaaaatgataccatcatttagaacagaaatggaaaatgaatggatttgccagcacgttgctgagaacatttttggatgggttgctaactttaaaacttaatataggccaggtgcagtggcttgttcttgcaatcccaggattttgggaggctgaggtgggagcatcacttgaggccaggagtttgagaccagcctgggcaaagatagtgagaccccatttctacaaaacagacaaataattagccaagtgtggtcgcatccacctgtagtctcagctacttgggaggctgaagtgggaggatggcttgagcccaggaggttgaggctgctagtgagctatgatcgcaccactgcactccagcctgggcaacacagtgagatcctgtctctagggggaaaaaacccttggagatttcacatgataattccaggggtctcccgtttcccattctgcacctcatattgaaacttgcccttcagtgcatagaaagcagggtttcagatttcatgtgtgtgcgtgtgcatttgtgtgtgtgcatgctgtgcgtgtgcatgtgtgttgcatgtgtaggcatgcgtttgggtgtgcatgtgtgggcatgcatgtgtgtgggtgtgcatgtgcacatgtgtttgtgtatgcgtgtgtgtaggcatgtgcgtgtgtgtttccctagaaaacttagaaaagctgaccactctgtgctgctggggccattcacttttaactcttttatttatttatttttgttcgtttttgagatggagtctcgctctgtcgcccgggctggagtgcagtggcgcaatcttggctcactccaagctctgcctcccgggttcacgccattctcctgcctcagcctcccgagtagatgggactacaggcgcccgccaccacgcccggctaatttttgtatttttagtaaagatggggtttcaccgtgttagccaggatggtctcgatctcctgacctcgtgacccacctgccttggccttccaaagtgctgggattacaggcatgagccactgcacccagccagactgttttatttcgtcacagtccctaaacctgcttcactcctctctgtgacctgcccgcccctgagtttgcaatcctgatcaggtctaaatctcccaggtcccagatgaataaactgaagcccagagttgggagtactttgcccaaagtcactcagggttgttggtcttcatctcatccatgatgggtcaggcatggaggcaggggtgggggcaggcaggacttcctcccatcaccaaatccttttcacctgcagcaaattctcaccccattttcttttcctgggtttttccaccaagtcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtggtgaggaatgtggggatcagtgcagctttgtgggaggggaggggagatgacggagtgcaaaggcatctgggtgggagagacgggtgaacaacatcattcatggccaagaacagagaccaagggcacgagcactcccttacagcgggccctcctcctcccctcacttctccccaaggtaggagacccctgaataatctgtcctccccaaactggtctcctcggcggtcagcatgccaaagagactgtcccttccccagactccaccccaggtctagcatagtcacaatagaagaagtttcagaaatggggcaacctggaagcttcccaattgcttagaatggccatagttggagagttccagaaatatcaattattaagaaggtccagccaggtgcggtggctcatgcctgtaatcccagcactttggaggccaaggcaggtggatctcttgaggtcaggagtttgagaccagccagggcaacatggtgaaactctgtttctactaaaaatacaaaaaattagccaggcgtggtgacatgcacctgtaatccagctattctggaggcttaggcaggagaatcacttgaatccaggaggcggaggttgcagtgagctgggatcgcgctactgcactctagcctgggcaacagagtgagactcgatctcaaaaaaaaaaaaaaggtccagtgttagagggcccattgtttcaaacatgaaggtgttgagtgatgtccttccagcccactatttagaacagtcacaagtgatgtactgtctctaaaaaataaaaaatagtaacaatgatagaacagtcacagctgaagagttctagaattgcccatcctttaggatagtcccagctgaagatgtccatgagtgccatactttagaaagtccccagtggaagacttccagaggtatccattgctaagatgtctgtagttagagttctagaaatgcctgctgttgggaatgtcagtatgtcaactcttggaattcttcaacagttgaagacattctccactgatgtactgagacttatatcagtagtacatcggttgagaatgtcctcaactgttgaagaattccaaaagtatgcattgcctggaatgctgccagaccattaccactcctgagatatgcccagtcctgcagggagagtccactgccaggactgtgagtggctgaattggatcaaagagaaatcaaacagagcatcctatcacatgcacgggccaggcagtgctggtgagtctgtgctccccatgcctgagtccagctactcaggcataggcttgattcttgtgggaagagaagagacactcagcccctttgatggaagctgggaaaagaggtggctctgctggaggcaggggctggcctggtttaaccctgacctggtgcatcctttccttgtactggcagagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagagggtaggtgtgaagctgggatggacaccccactcctggtatcaaattttgtcctgttctagccaccctaagccctgagctttctggcacagctgggaggtattcagttgttcatcctcagatgtagcccttcaattacatttctagagcccctgctggccaggccctgttgggtgccagctgcttcttctgttaggcatttgatccccctaactctgaagtgggaatcagccctgtttttcagacgagataacttaggctcagagaaatgaagttacttgcctggggtgaggaatgagaacaagatttgaacccagatccatctcacttcaagacactagcagtaacagcctctcctaccctcttccactctaccccagacccatttcccaccatgcccaccccatatggcctctggtagagttggtgccatttaaccctttctttgcttccttcccagagttaaaggaaggctggaaccctcacctgctgcttctcctcctgcttgtcatagtcttcattcctgccttctggagcctgaagacccatccattgtggaggtgaggccaggggatgaggaaggcagggaggtggtcagcctgggccactgcccctgtatgatacatgcagggttggaaaacatgactgtcatcatggtaacaatgatgatgatgggataataaccaactcacagccaccatgtgctggacactgtggagggcactcccttcacccccatggctgccctatgagcttgagacactgcagttgcccttattttacaaatggagaaactgaggcaaggagatgtcaaggacaaagtcacacagctccaaggtggagaaattgggattgaaaatctgtgcccttaaacagggacctcagctgtgatcttgtccagtggattttaagctttgaggcttaatgggcttaaggggccactaggtggtggtgaagaggtggctgtaatagtccacacctctgaaatggcctctctgcgcacccctggttgcagataaagaagttgaggctcagaaggggcaacatttgcccagcacgcaacaggcagccaagaacataaccacgatatcccttcaggagcctgtgagggagacttacttctcccattttacagaaggggaaaccaagccccagggaaggagggaggcgcctgggctgagtcttgggatgctcggaagctcctgtaggatgaagctggggagcgtccgaatgggaggccaggctgccctctggtgatgtcagggtcctcacccctctctgccccctcaggctatggaagaagatatgggccgtccccagccctgagcggttcttcatgcccctgtacaagggctgcagcggagacttcaaggtgagctcccgaccctgtgatgagctcctcggagcccctcctcctcttcaggagccccacctcccctcaccccaggctccccagcctcaccccacaggcctagagcatccaggtctcagccaagccacaagccaggcctcagtttccccatgtgcaaagtgtagacagtcattcttgtggtgcagaattggcagaagaattaaacaagatttgaccaggtgtggtggctgacatctgcaatcccagcactttgggaggccaaagcaagtggactgcttgaggccaggagttcaaaaacagcctgggcaacatagggagaccctcaccaccactccgcctccccatctctaccaaaaacttaaaaatcattcaagtgaggtggtgcacgcctgtagtcccagcaactcgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgggttggagagggaataggttctggaaagagcctggcccacggggcaaaacacactaacatttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctcactcattctcatattcacagcagcccctgcagagtggatgttccactgcccccagggcacccatgaggaggccaaagagtgggcagggaggaacatggaccccaacccacataagacccaccctttcctcttccctaaagctcaaatatcacattgattttgggttgatttttaccaatactcatatagcacttgctatataccaggcagtcccctaggagcatcacaaacagtgactcatttaatcctcacgacggccctacgggtgggtgctattattaggtccattttacagatgaggaaactgaggcaccgagagggtaagtaattggcttaagggcacacagctgagaagcgactttgaatcagtggtggtggccacatcacagttctgagatgagtttttgaggaagatgagctcaaaacagggagatacccattcctggggattttccttgccaattgcatgaggattctggtgtcgtgagtgggagtcctggcaggggagggaaggggagggtccttcaagtttaagggccaccgcctcagccagcatcacccacatcctttatcctcaaagtgtacaaaggcctttccaagtggcttttcattgatccactccacccattcatttcgttaataaacatttattgagcacctactttgtgctaggcactggggctacagccatggacagaagagacaagacttatgtccgggggccaagtgtctgtctggtggggacacataaaccaggagagtgctaggtttcaagaagcatcaaggaggcgggaaagcaggagatggctcaggggtacctcagacctcaggccctcctgcccccatgtctccttgactcaggaatcttggtccctgcctggactatggggccaccagttgtctgactggtcacactactaagggtagcaactcccttctacaagtagggaaactgaggcccagagtaggagggggatccactagggtgggagcacattgtggtcctgattcctctctctctctctgtctctcggtgtctttgtctatcttcatgtctctgtctgtctctcttgatgtctctttgtcttgtctctgtgtctgtgtctgtctttctgtctgtttaaaccctcaccttggctgggcacagtgactcacgcctgtaatcccaacactttgggaggctgaggcgggtggatcacctgacgtcaggagttcaagatcagtctggccaacatggtgaaaccacgtctctactaaaaatacaaaaattagccgggtgtggtgacaggcgcctgtagtcccagctacttgggaggctgaggcaggagaatcacttgatcctgggaggcagaggttgcagtgaaccgagatggcaccactgcattccagcctgggcagcagagccagactgtctcaaaagaataaaagtaaaagaaaaataaaccctcaccttaccctcatcctgtgctatgactctctctttttctctctcacagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggcaggaggctggaaggttctagaacactgatggttataagagtgggactgtgagcctgggatcggggggtgtgagacttggatgggagcacaagagtggaaacacagcttctgcacggagcaggcgcagccctcaacaccccgtgcacctgcaccctagggactcttgggtccagatgtgctgtggttttcacaccttcttgggggcaacaggttccaggagccacctgtgggtgccacctgagccacaggctcccaggaaagcagcacagctctcctgcacccagagcttgctgggtggcggaggggaacacagatggttggggaaggcctgaggccagattgggggactctggactggggcagatgaggctcctcagaatcccacctttgaagggaactcagcttataaacacagaggagcaaagttggagggccgggcgtagtggctcacacctgtgatctcagcactttgggaggccaaggaaggtggatcacttgaggccaggagttcgagaccagcctgggcaacatagcaaggccccatctctacaaaaattattattttttaaaaaaattagccaggtgtggtggtgcttgcctatagtcccagctactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagca

SEQ ID NO: 1797 - DNA, 49881 bp, Homo sapiens; identical to SEQ ID NO: 1796
  source 1..49881: mol_type = genomic DNA

SEQ ID NO: 1798 - DNA, 24785 bp, Homo sapiens
  source 1..24785: mol_type = genomic DNA
ctagaggcagctcagatagaggagctctttgggaagagacgccgggcaggcagaagcagcaggtaccccctccacatccctagggctctgtgatgtaggcagaggtaagaaattaggagggatgaggagttttttgtttgtctgtttgtttttttaaagacagggtctcactctttcattcaggctggagtgcaatagtgcaatcatggctcactgcagcctggacctccggcactcaagtgatcctccttcctcagtctcccgaatagctgggaccacaggcacacagcacccggctaacttatttttacttctatttttatttttggtagagacaaggtcttgctatgttggtcaagctggagatgaggaatattgaatctgggcaaaggagtttgcactttttgctgtgctgtggtcaagataaaaccatcagggagtgacggggacagagctatgtcaggactcgcaccgtggctggggtgatggatgtggacagaatagtgagggggcagacacagactccccctcctgcgatcagaggccacatcttcaaagtgtgataacaggacctctgcaggggttggaatcacacaggattcatattcctaaaagcaggttgaaactgcatctacctcaacattattttatttgagtagtgatgttattgcttaggatgatgctggagttaaatttttaagtgtgcttatctatagaaaatatattaaaatatgtattaaaataaacaacagtgcacacaatatacaaatatggccaaaattttggatatgagatattttggcaactcttggctagatcattctgagaccccctctgtttctgaggctctaccttctccatcaattacagctgttgtttgagtgtttatgtgatgggggccatctgcagggttttatgcaaatcacctccttgaattctcacaagcctggaagcaggccttgctgtttccactttacaaggctcagagagggcaagggactggcccggagccacacagctggtcatctgaaccttcctggccccccagcctgtgccctgccccagggttctttgatggctctgtgagggaggtcagagggaactatggatggggccagagtaggatctttgggaaccccggcacagaggaggaggatcttccccttgtggagtcagggatggcgtctggagaaagccatgcctgtgacttgggtcctgcatggggcatccctcttaggtttagctttagctccattcttgtctataggggctggtctgggaggggctcctgagtctgggcaggtggaccactgccctctggctggcacttcctcaaacagacacagagctggtgggtgaaacagacaagtcccaggagaagcctggcatcgccagactggtggggcattcctctgcccaagacagtagagggcactctttctggataaactcactctgctccccaaagaggttccttctccatcctggcccaaattaggaggtcaggttgtctctgtttggtcaggcctggatttcctagcatgctcccgagtgggctaatctgggctttgtgatggagtaaggagcctcattattgggctaaccttatcttaagtattcagcagtggttaactttgtgggttaactttggatttattattcagtaagaagccaatttattgatggctgggtgcagtggctcatgcctgtaattccagcactttgagaggctgaggtgggtggatcacctgtggccaggagttcgagaccagcctagtccacatggcaaaaccctgtctctactaaaaatacaaaaattagccaggcgtggtggcggccacctgtattcccagctacttgggaagctgaggcaggagaatcgcttgaacctgggaggtagaggttgcagtgagccaagatcgggccactgcactccagcctgggcgatagagtgagactttgtctaaaaaataaacataaaaaagccaatttactggcttttttttacaacatggatgtttataggaaggaagatccaaaattgctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtgactcatgcctgtcatcccagcactttgagaggccgaggtaggaggatcatgtgatcccaggagtttgagaccagcctgggcaacatagcaagatgccgtctctacaaaaatgttttaaaaattagccaggcgtggtggcacgtgcctttggtcccagctactcgggaggctgatgcaggaggatcgcttgagcccaggaggttgaggctgcagtgagccgtgattgcgccattgcactccagcctgggcaacagaacatgaccccatctctaaaaatattaaaataaaataataaaacaaattcactttgcatttgtgacgtgatggggcgggggcaggaagaaggtgggagaagggattcttggggtgaatctgccatttctaagaggtgggagttcttggggtcatccacaggcccctcgggatcttgcatttttcttaagacagttccaagaatcaggggcaagtctgcctgggaagagacaggatgagggggaggccgggggagccctgagcccgcctggctcaccctccactgtacgtctcttgcaggcccgtgggagtcagcatgccgcgtggctgggccgcccccttgctcctgctgctgctccagggaggtaagtggctgccccgtggtctgcgggtggggagggcccccatcacagagctgagccagggccgggctggctttctgggctcaaaaacacggctagagtccacagattcagaaaagatgacatccatgcccttgaggctgacacgagtccagtagccggctctccactaatcagaatccatccaccaaagggctccatgaaacagaagcggtagacatgagtctcaggtggcccagcccacaggcttgtgtcttcgggtgtcactggggggatgaaaggcttcgtccttcatttcccctgacctctgccttggctggctcccaactctctgagtgaggaagttctgccttccatctaacctcagtttctccttatgtaatgactctccttggaaatgtttttcaacaattgctgcaccgggtgcggtggctcctactggaatcccagccctttgggaggctgaggagggtaggtcgcttgagctcaggatctcaagaccagcctgggcaacatggtgaagccctgtctctacaaaagaaaaaaaattagccaggcataggagcgcatgcttgtagtctcagctttttgtggggctgaggcgggaggattgcttgagcctgggaggtggaggttacagtgagtcaaggtgacaactgtactccagcctgggcaacagagcgagaccctgtctcaaaacaacagcaacaacaacaacaataaacaaacaaaaaaatcgctagattcttagcaggcactggtggtccctgggctggggacaggaggaagagccaaaaggagactgaaccttggtaggcagcccccagaggaccagatgttgtggttagagggggtgacgttagaaagcagaactgggaagaccaggagtccgactgaaagggcactgcctaggactaagagatcctggagggcttcctggaggagggggccatgaggaggcgggatccagcacagacttgtgtggaggccggcctaggggcaggggaggaactcaacagctgctctgctgactcatgggcatttttctctggtttttaccagaagacccaggacctcaaatagctccttcaggaaacagatgtcaagctttgattttccctttctgagtggcaagcatcctcatcttggttctaaaaagcctttgggtcacccaccatggctccacatctggcgggtgcagataacaagccctggctgcatgcaaagctcggagcgtcatcccattccactgtcccaacagccccacaaggcgcatgttgtaatgacgcccagttttttggctgaggaggctcagagaggctaagagacaggtgcatggccacactacccggaagaggcagagctgggatcagtttgctcttggggtctgtcttagtctgtctgtgctgctgtaactgaatacgtgagactgggtaatttataaataatagacatttactgctcgcagttctggaggctgggaagtccaagatcaaggcaccagcagtagctttgattccggtgaggggcccatctttgctttttttttttgagactgagccttgctttctcacacaggctggagtgcaatggtgcaatcttggctcactgcaacctctgcctcccaggttcaagcaattctcatgcctcagcctcccgagcagctgggataacaggcacatgccatggctaattttcgtatttttagtagagttggggtttcaccatgttggccaggatggtcttgaactcctgacctcaaatgatccacccgcctcggcctcccaaaagtgctgggattaccgcacccagcccccatctttgcctttaagatgccacattgaacgctgcaccacccccagaggggacacacgctgcatcctcacatggcagaagggcaaaaagggtctgaatgttgggttcgtccagccctcttatagcatcaataattcattcaggggggctctgcccccatgacttaatcatctcctagagtccccaccttttaatatgatcacattggcaactgagtttctggggagacacagacgtcaaaccgtagcacggccttcaccatgctgtgctgctatctgtggagtgatagccatgtgcgggcagcatgcaggcacaggcatgatctcatctcaacacctcaacagcctctagggcaagcagtgtctccggcttacacatggggaggagaagcagttttgagtcacatgtttgcagtcacagagctactttgtgcacctctcactgcctcctgcacgctttcataaccccagacatgggatggccctggggctctctgccctgtggctggggtactgacagggcattttcccaccctctcatccctggtgccacctccctgccactcaggggctgccgttgcctccccaagtttggagacaaaccctgtcccttggtagctttgagcctggctaggaatggtagctcctctccaaattcccagagctctgagaaagaaccacgaggatacgaactcagagatgacacagctacttagaggctctgtgttgaggttttgccaaaatcagtcctgttttctccaccaagtgctggaactagctccttttcactccaccgacaagttctgtgtgtctccctgaggaaagccccctcctagagcaagatttacttccatgactcagatcccttggtagccactgcctcgagagaagttgagaagcattccgaggtcacacctaggggagggagtgctgtgatccattagcaatatctgtcatgtgtgcggctatgaaaaactagcacagactaggtatttccttccctgggtgagtgtctcagcagcccagaccaagagagacaagaggcatggtctagtcttggagcctcagtgttctcatctctacaatgaactaaaggatatttccagacacagtattcttggctccgcatataggttctgtcctagagtgagacccaggaagggaatctaccaccaccacctcaggggtcttcattagtccagggaaaataggaaaaagccaccaaaaatgaacctacttaaaaaggggaacaaggtcaggcacgatggctcattcttacaatcccagcactttgggaggctgaggcaggtggatcgcttgagctcaggagattgagaccagcctgggcaacatggtgaaaccctgtctctacaaaaacacaaaaattatccaggcatggtggtgcacaactgtagtctcagctactcaggaagttgaagtgggaggactgcttgagcccaggaggtggaggctgcagtgagctgagatcgcaccactgcattccagcctgggcaacagagcaagagatcctatctcaaaaagaggtgagcggtacaagtttctagtaaatagcagcaaaaaatagtggaattggcactcgaatatacaaaacaaagctacaaattattccattgattttgtccacatttaacaaaatgtagatgatgattgcacccctgttttagaacacagcgaaacaattaatgtttggggagcaggatggaaaggtgttaaatcttccaacaaaattgcctcatagggcaatacctagaagacttcttggtggcggtggcatttttggccgcaggatcacgcagacctttatgcaaaagtgtccgagggctttttaattctctcacggtttcctactccttgaagcacttcctgaatctccgagagtgggtgtcctgtggatccaacttctgtagagccgagtcctcttccttgtcagggttttgggacattttcagcatagctgtccttgactctatgaggtcctgaccctcttggggtgtgtgcgtgtgctctggctgggttcctaccacatctggggcatttaggatattgccattctgagtgggagcttggccaggagggacacagacctggtggccgggcgcagggctctggaggagggtgctgagctggggaccagctagttttatattatttgccatcacatgcatcctgtcttcatagccagccttgaaacattggtgctcaaacaaggaatttccaggtggtgaggccccctgggtgccaggcctacatctaagcagctcctgagtcctcatatttgtcccggcctggggacccctgcacccattcttcctccagccctcgaggggatggagaggaagctctgcagtcccaagccaccccccaccaaggcctctctccccactgaccctccaggctggggctgccccgacctcgtctgctacaccgattacctccagacggtcatctgcatcctggaaatgtggaacctccaccccagcacgctcacccttacctggtaagtagccgggcctcaccagtccccggggatgcaattcagggtgcctgctcagtgattcccccaggaggacactgtgcactgaggaccactgtgtccgcctttcagacaaccactcagggctcacaggacttgaaaagtcaggagcccgcagggttggtctatccaccagcttcaaaggccactctctcacccacacaggtcggccatggttttgagaccccgggatggctggtttcccgcatgatttttcaagcacttaggtaccaggcccccaactacacgcttcccatgaatggtcacccccaaccctcacaatgattactcccattttacagatgaggacattgaggttcagagaggttaagcaacttgcctaaggtcacacagccagtgaatgctggagctgggattcaaattcagaccgcccaactccaaagtccatgggtcccttttagaccctatgcagctcaggataaagaagagcttctgttatccatcagctcattcattcattcaaaaccatttataggccaggtgcagtggctcatgtttctaaccccagcactttgggaggccaaggaaggaggatcacttgagcccaggagtttgagaccagcctgggcaacatcacaaaaccctgtctctacaaaaaataaatcagtcgggcgtggtggcacaatcctgtaatcccagctacttgagagtctaaggcagggggaccaagctcaggaggtcgaggctgcagtgagctatgatcacgccactgcactccagcctgggcaaaaaagcaagatcccaactcaaaaacaaaacaaaacaaaacaaaacatgtattaagttcctgccagacactgttgcaggcactggggattcagcagagcaagactgaccaggccccagatgccttggaactgacgtaccacggtggggcggaggctgggggagacagacacacaaaacaaccaacaaggtgctttctcttttttattttattttattttattttattttatttttttgagacagggtcttgctctgttgcccaggctggagtgcagtggtgggatcagaactcactgtagccttgacctcctgggctcaagcaatccctccacctaagcctcctgagtagctgggactacaggcatgcatcaccatacctggataatttttgtagtttttgtaaagacagggttttgccatgttacccaggctggattcaaactcctgggctcaagcaatctgcccacctcagcctcccaaagtgctgggattacaggtgtgagccaccatgccaggcccaaacaggacactttctttctttcttttttttggagacggagtctcactctgttgcccaggctggagtgcggtggcatgatctcggctcactgcaacctccacctcctgggttcaagcaattctcctgcctcaacctcccaagtatctgggattgcatccaggtgtgcaccaccatgcctggctaatttttgtattttaagtagagacagggttttgtcatgttagcccacctggtctcgaactcctggcctcaagtgatccgcccactgtacccgcctttcagacaaccactcagggctcacaggacttgaaaagtcaggagcccgcagggttggtctatccaccagcttcaaagaccactctctcgcccacacaggtcgcccatggttttgagaccccgggatggccggtctgccgcatggccagcctcccaaagtgttgggattacaggcataagccaccgtgttctgccccaaacaggatactttctaataatactgggtgctatatcaaggacagaacactggacctcaggtaaagggaccacaactgctagtgagaaggaggaagccagggagctgggcagagggcactgccagtgcaaaggccctgtgggagaagagctggtgcgtttgaggaatagggaggaggtcagtgtggctggagtggagtgaggcagggtgagggggaataaggagcaagttcaggctgggaggcttggagagcatttattcagcaggaacttgtattccagcaaatttggcagagaactcagtccacacatccctactgggcctagagagtggtcatgttcagatcctgaacatctaggtagggaaattaatatccggtaaactactatacatacttcaaaacccatcatttttgtccagtgggagttaaaaagccacagcattttccctaatcccatcccaccaactttcccagaagtccacccagaggaggagatgaggttcatttagctcttttcctggccctcagcacaggctattattagatattcagtggatttggggactgggcgaggtggctcagtcctgtaatcccagcactttgggaggccaaggctggcagatcacttgagcccaggagtttgagaccagcctaagcaacatggtgggaccccatctctacaaaaaatacaaaaagttagctgggcatggtggtgcatgcatgtagtcccaggtactgaggaggctgaggtgggaggatcagctgagcctgggaaggtcgaggctgcagtaagccatgatcacactactatactccagcctggggccagagtgagaccctgtctcaaaaaaatggatgttggacagaaaggagagaaggaaacccaaaatgcctagcgcccttcctgcaggacagccatctggttgttgggaccaacagggacagatttaggcttagtccaagcaagaatggcccaaatttccaaaattgagagctgctgccctaaatgaggtagtgagttcctggcccctgggaggtgtgcaagctgagcccggacacaattcattgaggatgctgtaggggaggtgataccttccctgggaaaaggttggttggaccaggtgaccaccccccagccctgcctcaaatccctcccagccctgagagtctgggcttctgccctggccctgagcactgagcccaccaccatcccccctgcccctggcttccagccatgaccggctgctttgtccttgaaggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcagtgagtatcctgggaccccaggcttagggtggcactcaatcttagctcaccgcagccctgacctctctgggctcaggtgatcctcccacctcagcctcccgtgtagctgggacaacaggtgtacaccactacacccagctaatttttgtatttttagtagagacggggatcttgccatgttgcccaggccagtctcgaactcctgggctccagcgatccacttgccttggcctcccaaagtgctaggattataggtaggggctgggtcccctactccctgccctctgggccagctctcctccttccatcagatctgacctggcctatgtcctcactacaccttagagttctgttttgagttgcgctattttttactaaagtgtgaaaggttgataataggtttgagaggtattgaaggagctaggctgggacccgggacttctgggttcgtgttccggctcagctctgcccatctgtgtgaccatggatgaggcatacctacctctgggacagcttccctatttgtagagcaaatgtccttttaaccctgactttctgggatcctgaccccataatgaggcgaatggacgacactgagttacagaaaaaaaaaaccctcttgggttttttccccttcataagctccagggaggcctggaatttccctccaggctggaggtagaggggggtcccaggggcaggagggcctggttggtgggagcagttttatctgtgagttcagaattagggcaggtggcagggcgaggtggctcatgcctgtaattccaacactttggaaggctgaggcaggaggattgcttgaacctggggctttaagaccaacctgggcaatatagcgagacctcatctcaaaacacaaaacaagaaccagggcaggggccaggcactgtggctcacgcctctaatcccagcactttgggaagctgaggcaggtggatcgtttgaggtcaggtgttcgagaccagcctgggcaacatggtgaaaccccatctctactaaaaatacaaaaaaatttgccgggcgtggtggcacacgcccgtaatcccggctactcgggaggctgaggcaggagaattgtttgaacctgggagacagaggttgcaatgagccaagatcatgccaccgcactccagcctgggcgtcagagtgagactccgtctcaaacaaaacaaaacagaactaggcagggcatggaagggcctgggaggtggctttggcatggtgtgtgtgtgtgtgtgtgtgtgtgtatgtgtgtacccaaagcggccccagaggcaaacacaggctgcaaagggagcctgccctcaggaaggccccgcccatgagctcgggagtttctgccgctagattcccagcagaggggctggggtataagaggtgtctgtgattcacactctgggggtccaggtttgcacctctttgctgagtggatgtcacaccacagagcgtgagagtgaagcttcacacactcccagacacatgcacactcacgcaaattcccagggtcacagactcacgcacacacagactcatagatgcgccctcaaactcacagatgtctccccagccccagcctgcatggcatggacacagaggcccacactgcctctctctcttgctctctctcactctcatacacactcacacatacatacacacacacacacacacacacgtacacaatacacacacactcacacatatactctcacatcactcatacatgggcacacacacgcacacactcacacatgcattctcacacacgtgtagactcacacatgcacacacatatacactttctcacacgtgtgcacacacgcacatatacacatactcatacactctcacatcacacacgggcacacatatgcacacactcacacatgcattctcacacacgtgtacactcatgcacagacacacacattactcacgggcacacatgcacacactcacacatgcacagactcacaaggggaccctccttgccacttgtcttgcagcgtgaatccaagcatttctctctggcattccctccctccctgccaggatctgcagctagcctggtcccagctggggcaggaagtgattttctaaccacctcccgccgagggtcccttcctcctcctgggccctgggcctcgctgggctgagcagcccctcttcacgacccccaggctctgcaaacatctcccgagtacccacggggcagttctcagtaccctggtgtcttctgggactcatcctcacccagccacacagggaagccgagagccggcctccacctgccccggggaagacaaaagaggggttagaaacgatttcagtcaaaaacatcccattactggaacagcaacagcaacaacccagtgttcaccatggcattctgtaaaatgtgcacctctgtcacctcggggcgtggtgggagccctcagtgcgggtttcaggatcacaggcagccttagagctcctttctggaggccttgcaaggttcattagttaatctgacaaatatatatatatatatatatatatatagagagagagagagagagagagagagagagagcgagcaagcgcgcgccagggtgtagctttgtcctccagcctggggtgcagtggcacaaccatagctcattgcagcctggaactcctgggctcaagcgatcctcccacttcggcctcctgagtggttgggactacaggtgcacatcaccatcctggctaatttttaaattttttgtagagctgggatcttgctgtgttgtccaggctggtcttgaacacctggcctcaagcaatcctcccacctcagcctcccaaagtgctgagatttttggcatgagccaccttgcccagcctaatttgccaaatatttattgagggcctactgtgccccaggctgtgttctaggagctgtgggcacagactgaacctggaggacaaaacctctgccccaaggagctaagagcccagtgagggaggcacatagtaaacaaaatcacagggtgagaggtgcagagtgttagatggtggcagattgaaagtgaagaaggtggctgggtgtggtggctcacacctgtagtcccagcactttgggaggttgaggtgggtggatcacttgaggtcagaagatcaagaccagtctggccaacatggggaaactacttctctactaaaaatacaaaaattagccagtcatggtggtgcgcacctatggtcccagctacttgggaggctgaggccgtgtaatcgcttgggcttgggaggtggagactgcagtgagctgagatcacgccactgcactccagcctgggtgacagagattctgtctcaaaaaaaaaaaaaaaaaaaagaaagaagagaaaaaagaaagggagggagggagggaaggagggagaaaggaaggaaggaaggagaacaaaaaaagaaaaagtggagaaggtgagggcagaggcctgcaactcctctctgacactaatagacacttgtcactcagttcctctgaagttactgccttctgctaaatagcttcatccctttgaacttgaagccccatgatataggaactgagcccattttacaagagaggaatttaaggcccttaacatattgtgttctgctcaagttcatgaaatgtccttcgaatggagcaaaaacagaatgccggctttgaccttcacctggaggccgcccatgaaagcttgctgttatggctcagagctcggctcttgcacttgccaggagacgctgaaagatgaggaccatcagattggcctcccagggccactgtggggtgtcaaactgcccagagcagggcagccaggcaggctctgtgtaaatggcagccctcaccattagcattcatgctaagaagagtcatcaactgcttgaagtagctggggttgaaagaaaatgataccatcatttagaacagaaatggaaaatgaatggatttgccagcacgttgctgagaacatttttggatgggttgctaactttaaaacttaatataggccaggtgcagtggcttgttcttgcaatcccaggattttgggaggctgaggtgggagcatcacttgaggccaggagtttgagaccagcctgggcaaagatagtgagaccccatttctacaaaacagacaaataattagccaagtgtggtcgcatccacctgtagtctcagctacttgggaggctgaagtgggaggatggcttgagcccaggaggttgaggctgctagtgagctatgatcgcaccactgcactccagcctgggcaacacagtgagatcctgtctctagggggaaaaaacccttggagatttcacatgataattccaggggtctcccgtttcccattctgcacctcatattgaaacttgcccttcagtgcatagaaagcagggtttcagatttcatgtgtgtgcgtgtgcatttgtgtgtgtgcatgctgtgcgtgtgcatgtgtgttgcatgtgtaggcatgcgtttgggtgtgcatgtgtgggcatgcatgtgtgtgggtgtgcatgtgcacatgtgtttgtgtatgcgtgtgtgtaggcatgtgcgtgtgtgtttccctagaaaacttagaaaagctgaccactctgtgctgctggggccattcacttttaactcttttatttatttatttttgttcgtttttgagatggagtctcgctctgtcgcccgggctggagtgcagtggcgcaatcttggctcactccaagctctgcctcccgggttcacgccattctcctgcctcagcctcccgagtagatgggactacaggcgcccgccaccacgcccggctaatttttgtatttttagtaaagatggggtttcaccgtgttagccaggatggtctcgatctcctgacctcgtgacccacctgccttggccttccaaagtgctgggattacaggcatgagccactgcacccagccagactgttttatttcgtcacagtccctaaacctgcttcactcctctctgtgacctgcccgcccctgagtttgcaatcctgatcaggtctaaatctcccaggtcccagatgaataaactgaagcccagagttgggagtactttgcccaaagtcactcagggttgttggtcttcatctcatccatgatgggtcaggcatggaggcaggggtgggggcaggcaggacttcctcccatcaccaaatccttttcacctgcagcaaattctcaccccattttcttttcctgggtttttccaccaagtcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtggtgaggaatgtggggatcagtgcagctttgtgggaggggaggggagatgacggagtgcaaaggcatctgggtgggagagacgggtgaacaacatcattcatggccaagaacagagaccaagggcacgagcactcccttacagcgggccctcctcctcccctcacttctccccaaggtaggagacccctgaataatctgtcctccccaaactggtctcctcggcggtcagcatgccaaagagactgtcccttccccagactccaccccaggtctagcatagtcacaatagaagaagtttcagaaatggggcaacctggaagcttcccaattgcttagaatggccatagttggagagttccagaaatatcaattattaagaaggtccagccaggtgcggtggctcatgcctgtaatcccagcactttggaggccaaggcaggtggatctcttgaggtcaggagtttgagaccagccagggcaacatggtgaaactctgtttctactaaaaatacaaaaaattagccaggcgtggtgacatgcacctgtaatccagctattctggaggcttaggcaggagaatcacttgaatccaggaggcggaggttgcagtgagctgggatcgcgctactgcactctagcctgggcaacagagtgagactcgatctcaaaaaaaaaaaaaaggtccagtgttagagggcccattgtttcaaacatgaaggtgttgagtgatgtccttccagcccactatttagaacagtcacaagtgatgtactgtctctaaaaaataaaaaatagtaacaatgatagaacagtcacagctgaagagttctagaattgcccatcctttaggatagtcccagctgaagatgtccatgagtgccatactttagaaagtccccagtggaagacttccagaggtatccattgctaagatgtctgtagttagagttctagaaatgcctgctgttgggaatgtcagtatgtcaactcttggaattcttcaacagttgaagacattctccactgatgtactgagacttatatcagtagtacatcggttgagaatgtcctcaactgttgaagaattccaaaagtatgcattgcctggaatgctgccagaccattaccactcctgagatatgcccagtcctgcagggagagtccactgccaggactgtgagtggctgaattggatcaaagagaaatcaaacagagcatcctatcacatgcacgggccaggcagtgctggtgagtctgtgctccccatgcctgagtccagctactcaggcataggcttgattcttgtgggaagagaagagacactcagcccctttgatggaagctgggaaaagaggtggctctgctggaggcaggggctggcctggtttaaccctgacctggtgcatcctttccttgtactggcagagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagagggtaggtgtgaagctgggatggacaccccactcctggtatcaaattttgtcctgttctagccaccctaagccctgagctttctggcacagctgggaggtattcagttgttcatcctcagatgtagcccttcaattacatttctagagcccctgctggccaggccctgttgggtgccagctgcttcttctgttaggcatttgatccccctaactctgaagtgggaatcagccctgtttttcagacgagataacttaggctcagagaaatgaagttacttgcctggggtgaggaatgagaacaagatttgaacccagatccatctcacttcaagacactagcagtaacagcctctcctaccctcttccactctaccccagacccatttcccaccatgcccaccccatatggcctctggtagagttggtgccatttaaccctttctttgcttccttcccagagttaaaggaaggctggaaccctcacctgctgcttctcctcctgcttgtcatagtcttcattcctgccttctggagcctgaagacccatccattgtggaggtgaggccaggggatgaggaaggcagggaggtggtcagcctgggccactgcccctgtatgatacatgcagggttggaaaacatgactgtcatcatggtaacaatgatgatgatgggataataaccaactcacagccaccatgtgctggacactgtggagggcactcccttcacccccatggctgccctatgagcttgagacactgcagttgcccttattttacaaatggagaaactgaggcaaggagatgtcaaggacaaagtcacacagctccaaggtggagaaattgggattgaaaatctgtgcccttaaacagggacctcagctgtgatcttgtccagtggattttaagctttgaggcttaatgggcttaaggggccactaggtggtggtgaagaggtggctgtaatagtccacacctctgaaatggcctctctgcgcacccctggttgcagataaagaagttgaggctcagaaggggcaacatttgcccagcacgcaacaggcagccaagaacataaccacgatatcccttcaggagcctgtgagggagacttacttctcccattttacagaaggggaaaccaagccccagggaaggagggaggcgcctgggctgagtcttgggatgctcggaagctcctgtaggatgaagctggggagcgtccgaatgggaggccaggctgccctctggtgatgtcagggtcctcacccctctctgccccctcaggctatggaagaagatatgggccgtccccagccctgagcggttcttcatgcccctgtacaagggctgcagcggagacttcaaggtgagctcccgaccctgtgatgagctcctcggagcccctcctcctcttcaggagccccacctcccctcaccccaggctccccagcctcaccccacaggcctagagcatccaggtctcagccaagccacaagccaggcctcagtttccccatgtgcaaagtgtagacagtcattcttgtggtgcagaattggcagaagaattaaacaagatttgaccaggtgtggtggctgacatctgcaatcccagcactttgggaggccaaagcaagtggactgcttgaggccaggagttcaaaaacagcctgggcaacatagggagaccctcaccaccactccgcctccccatctctaccaaaaacttaaaaatcattcaagtgaggtggtgcacgcctgtagtcccagcaactcgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgggttggagagggaataggttctggaaagagcctggcccacggggcaaaacacactaacatttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctcactcattctcatattcacagcagcccctgcagagtggatgttccactgcccccagggcacccatgaggaggccaaagagtgggcagggaggaacatggaccccaacccacataagacccaccctttcctcttccctaaagctcaaatatcacattgattttgggttgatttttaccaatactcatatagcacttgctatataccaggcagtcccctaggagcatcacaaacagtgactcatttaatcctcacgacggccctacgggtgggtgctattattaggtccattttacagatgaggaaactgaggcaccgagagggtaagtaattggcttaagggcacacagctgagaagcgactttgaatcagtggtggtggccacatcacagttctgagatgagtttttgaggaagatgagctcaaaacagggagatacccattcctggggattttccttgccaattgcatgaggattctggtgtcgtgagtgggagtcctggcaggggagggaaggggagggtccttcaagtttaagggccaccgcctcagccagcatcacccacatcctttatcctcaaagtgtacaaaggcctttccaagtggcttttcattgatccactccacccattcatttcgttaataaacatttattgagcacctactttgtgctaggcactggggctacagccatggacagaagagacaagacttatgtccgggggccaagtgtctgtctggtggggacacataaaccaggagagtgctaggtttcaagaagcatcaaggaggcgggaaagcaggagatggctcaggggtacctcagacctcaggccctcctgcccccatgtctccttgactcaggaatcttggtccctgcctggactatggggccaccagttgtctgactggtcacactactaagggtagcaactcccttctacaagtagggaaactgaggcccagagtaggagggggatccactagggtgggagcacattgtggtcctgattcctctctctctctctgtctctcggtgtctttgtctatcttcatgtctctgtctgtctctcttgatgtctctttgtcttgtctctgtgtctgtgtctgtctttctgtctgtttaaaccctcaccttggctgggcacagtgactcacgcctgtaatcccaacactttgggaggctgaggcgggtggatcacctgacgtcaggagttcaagatcagtctggccaacatggtgaaaccacgtctctactaaaaatacaaaaattagccgggtgtggtgacaggcgcctgtagtcccagctacttgggaggctgaggcaggagaatcacttgatcctgggaggcagaggttgcagtgaaccgagatggcaccactgcattccagcctgggcagcagagccagactgtctcaaaagaataaaagtaaaagaaaaataaaccctcaccttaccctcatcctgtgctatgactctctctttttctctctcacagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggcaggaggctggaaggttctagaacactgatggttataagagtgggactgtgagcctgggatcggggggtgtgagacttggatgggagcacaagagtggaaacacagcttctgcacggagcaggcgcagccctcaacaccccgtgcacctgcaccctagggactcttgggtccagatgtgctgtggttttcacaccttcttgggggcaacaggttccaggagccacctgtgggtgccacctgagccacaggctcccaggaaagcagcacagctctcctgcacccagagcttgctgggtggcggaggggaacacagatggttggggaaggcctgaggccagattgggggactctggactggggcagatgaggctcctcagaatcccacctttgaagggaactcagcttataaacacagaggagcaaagttggagggccgggcgtagtggctcacacctgtgatctcagcactttgggaggccaaggaaggtggatcacttgaggccaggagttcgagaccagcctgggcaacatagcaaggccccatctctacaaaaattattattttttaaaaaaattagccaggtgtggtggtgcttgcctatagtcccagctactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagca

SEQ ID NO: 1799 - DNA, 51677 bp, Homo sapiens
  source 1..51677: mol_type = genomic DNA
aaaaaatatcatttattcttttataaacaatagcaataaatttattatatgttaacagcagagtgatgacatcatcacgtatcacatagcttctggaaaattccaccatacacttttgagagaaggacagataaatggtcgataacatcttagtattatcatggaaaagttttgatcttatagacccctcaacacccaaaagtcgtaatcagttctactcaagtaagatttaaatatatatctatattttctggtctgagattcttttcaactttactcagaaaacatatacctgaagggggagggggagagtgcacagatgagtctgtttgtatgtggttggtcacagaaatgacagaaaatagttatttaatctgaatctggaccctgctgaaaactgccgtgatttctcataacactctcctgccccttcagaagtgaaaactggctgatagtttcccaaatgaataattttcgttaatgttaatcgtgtgatgttgttgagctagaatgttgactcaactgattcgtgaggggagatcttgcaccagatatggaaccaggacttccaccgaaatcttagctctggaagttgatttttttcgtgggagttgagagtgggtgggcgtgcagagcaataacacaatggttctcaaagtgtgttcctggaatagtagcagcagcaacagcacctgggaattgttagacacacaaaacatttggctctattccagaccaacaactcagagactctgaagatgggcccagcgaactcttttaacaaggcctcccggtgattctaatatgctgaactttttgataatgttcaaggactgctggtatgctcatcttgtctttttttccttaaagacaggatcttgctctgttgcccaggctggagtgcagtggtgccatcatgactgactgcagcctcgaactcctgggctcaagcaatcctcctgcctcagcctcctgagtggctaggactacaggcgtatgccaccacatccagccaatttctaattttttgtagggatgtgtcttgctatgctgcccaggctggtctcaaactcctggcctcaagagatgctcccgccttggtctcctagggagctggggttataggcctgagccaccgtgccaggcctgatgcgctcttttccgtggttacgttctaccagtgtgacctccatcccttctccctcttcacttccttctttctttccttccttgcataaacattgaatgtacggatccctttttggtgtttttagacacttctcaggaaacgtacgcattgatttgcaccttgtgtgtccacctgtaaacatcaaattagtgcaggccaaattcagggtatcattcatagcaatcccaaagaaactaactcttaaagaggccaattagtaacgcacaggtaaaactttgctaagtatgattctctgcctgggacctcattcatccttctgttcctgacattgcctcatgggtttggctgccccgttttgaagttacccaaagattattctgccatggcctctgttttttagaaattcaagactgaaggctcagtagaagggggttagcttagaggattgagccaagggtaaaatgatttctgggtagcagcccagagttcttgaaggatgtttattaggcaacgtgaacgggagaatcagcagtcagaagcggctgagaaaggaaccacgcagacaatgtccagttgtatagggtagagtgtgtgtgttgtgtatttacgttagtgctggggctttccttgggactcctgaactgggaagttggaatgagatgaatgtaaacctacttttctttatactacatatagggtggagagagttccataccattcatgctttaatgaacacatatacatgaaaataagatggagagttctagtggttttgcccttcctcttcaacggcgaaattgctatttagaagtgggtagcgctcgctctctgatgggactgagctggcatagagacaaggttgccactgccccgtgtcctgtgatgtgacttcagagcttccaaaacgcaggcaagcacaacggatgtctcctgggcgaccatttagcacctttgatttcacttgggcttcatgacttctgttgtctgttcccggcttcttaccaagaaattcttgttcttttggttttctagattgttcttctactcttcctcctgtagtggtgtaacaaagtcacggtcatatgtgtaacacggcaccaaaaaaatgtggtcctcactctaaaccagtgcacacgccaccatgcctggctaatttttgtatttttagtagagatggggttttgctatgttggccaggctggtctcgaactcctgaccttgtgatctgcctgcctcggccttccaaagtgctgggattacaggtgtgagccactgtgcctggcctaagtttttatatggcagacaatagctgtggaacaggaataataaacagcaactaactgtgctaaatgatgtgcatgcagtaaagcacttggtttctagccagcactgtgctatagaactttctgagatgatggaaatcttttgcagttgtgctgtccgataacacagacacctgtggctagggaacgcttgaaatgtggctagtgcaaccgaggaactgaatttttaattgtatttaatttatttgagtttaaatacacttaagtatccacaggtggctagtggctactgtattggacaatacggtcttagccttttcccagttcttatttggctcatgggaatttctaattactccctactttgcacagagttcccatagcacaagactccaagcagaggtgtgctggtgatgtttaacaagcagctctctgatgacggttgcctgtcttccctggtgtcaatcctccctccacacacagcttccagctggcaatgtgacatcactgatcacgcggttgggaagagatgcgcggtagccaccgtcaaacggtatttccaccatgcggacacaatagatgtaaaccacccagcgaacaaagataacagtaaaaggtagcaaataattaggaagtgatcagttgtaagtaattcttgcctttgtttttaatataatttattaaattgtaaatttaaatattttaatttttttttttttttttgagacagcgtctcaatctgtcacccaggctgcagtgcagtggcatggtcacagctcactgcaatcttgaactgctggactcaagggattctcccacctcgcccttaccagtagctgggactacaggtatgtgccacctcgcctagctaagtttaaaatgtttttgtagagacaaggtctcactttgttgcccaggctggtctcaagcgagcctctcaccttagtctcccgaagtgcaggaattacaggcaggagctactgctcccagcctaaatactttaattttccataatggctatgcttaaaaaccagtttgcagaagtcccgaaaatttaaccgctggctctcacaagccactgtgagccttctgtagcacatcacgggctcctggtcattgcccgaaacaaacaaaaaatatttccccaaccaaaactctctggctgggctacagtgatctttcggtaattcaaatgcagcatttctgttgccacaagagggcaccatgggttgatatcagattctaggaaggcttttggacaaactgactagaggggtcatttctagatgtatgtttgagtctccccaaagattgtagttctgggagaccttgtgggaactcacataggttcacacagttatttgtttcacaacataaacactgaaccattcctacttccaaatagctttgtcctctgggcccgaaggcttttgatcttcaaactaacaaatgaaaaaaatccttgcaaggtgttaaggcttgtcaggtgttcagcctgaggaaggagaggatgcaagtactgagtacacgtacaacatgtcagccacgtcacatccttcccctcctggaagcctaaaatgacaccttaggagtcagctaaccccttagagaaactggtagactgccgggtatatgaatcattcctgctacaataaccctagggggcttatcatttgcactgcagtaatttatactttttaattcccatgaggaaaattaggagtatgttatggacctgatgacccatataagaagggaagagatattttatttttctctctggctgggctaagggctttggttttgggggagtggatctgtattttctcagggtcttactgtggagtttgtatcagggttggccagagtggatgctggcaggggtcagggaggccctggataatcaagagagagacagagggagtttctagagtttactttttctttttctttcttttcttttttctttctttctttttttttttaaacagagtcttgctgtgtcacccagggtggagtgcagtggtacgatctcagctcactgcagcctctgcctcctgggttcaagcgattctcctgcatcagcctcccgagtagctaagattataggtgcgcaccatgacagccagctaatttttgtatttttagaagagacagggtttctccatgttggccaggctggtctcaaactcctgacctcaagtaatccgcctgcctcggcctcccaaagtgctgggattacaagcgtgagtctggccagcttccctgattcttaatgctgttagcctagtgcggtgatcctcagagtctgctccctggaacggcagcgtcagtatcacctgggaacctgatagaaatacagattcctggacctaagcaagacgactgcgtcagaaactccacaggtgggacccagcaatctgtgctttaacaaggcctccagatgattctttcaacaaatgtttttaagttgacacataatagttatatatatttatgaggtatgtagggatgctttgatacctacaaggtacagtgatcagatcatggtatttagcatatccatcatctcaaacatttatcgtttctttatgttcctacagatgattctggtgctagttcaagtttgaaaaccaatggccgggtgtagggttgtcaaacctggatgcatatgtattagatacatctgaggggctttaaaacgtacgactatcccagacataaaaggccacgtgattccatttacacgaaatgtccagaataggcaaatccatagagacggaacatagagtggtggtttcccggggctggggagaatggggaacttggcagtgtggggcttctcttgggaatgatggaagtattctggaatcagtggggatggctgtacaacattgcaaacatactaaataccacttactgtggtttgaatacatcccccagagctcaggtgttggaaacttaatccctaatccagcaatgttgacaggtgagatcttgaagaggtgatcaggtcgcgagggctctgcctcatgaatggattaatgttgttattgcaggagtgggtttgtgataaaagctgagttcagcccctcctgctgtctctcactctcttgcccttctgccttctgccacaggatgacgtagcacaaacgcccttgatacatgggggcccctcgacctcagacttcccagcctccagaatggtaagaaatctctgttctttataagttataaatctctgttctttataaatctctgttctttataagttacccagtctcaggcattctgttacagtagcacaaaatgggctaagacaccactgaactgtacattttatgatggttaaatgatgaattttatctcaattaaaaatacgtactgatgtcttgggctcaccccagacattctgactggagcccaatcattgatatcttttacctttttcttttttttttttgagacagagtttcactcttgttgcccaggctggagtgtagtggcgcgatcttggctcactgcaacctccgcctcctgggttcaagtgattctcctgtctcagcctcgcaagtagctgggattacaggcacccaccaccacgcctggcttatttttgtattttttagtagaaacagggtttcagcatgttgtccagcctggtcctgaactcctgacctcaggtaaccacctgcctcagcctcccaaagtgctgggattacaggcatgagccacaactcctgggctatcttttaactttttaaattattatgctgttttggctgaacaacctacataagctacaaaaatatttcctattgcaacaaatttgttcttctattgttgcaaatgaagattccccccaaattcaaagtgggtcacaatggttttggtgacaggatttccctcttgtaaacctctcttaaaagatgtcacagctatgaataacactgagccacaggagaagcacagccctttggactgccttccttttcctgtggaatttactcatatcttgccactcactggtattttagaagactgtctcctggatgttctaagatgcatgcagggttgaaaatctgagttaatgcaaaaagaccacacatggtttacattcctggtcaaggggatgccggtgtgagcttctgtggacgggagggtggggagcacaggataggcaaagctcagcatagatgctgccctgggtcctctataggtaggggctgggtgggaaaatcatgggctctagattcatgttgcagtgctggcctctgctgtgccatcttctccaagctgttgcatctctctaggccacagctattccaaaggtttctgagaaggtagatttcaataatgtttataaaacaagcatcaagcctggtgtatagtgggtgctcaatgaatgtgaggctcctttgccttcccatttccctggtcgtttaatttttttttttttttttttttgagacagagtcttgctctgtcacccaggctggagtgcagtggtgagatttctgttcactgcaacctccgcctcccaggttcaagcaatcttcctgcctcagccgcccaagtagctgggattacaggcacctgccaccatgcccaactgattttttgtatttttagtagagatggggttttgccatgttggccaggcttgtctcaaactcctgacctcaggtgatccactcagccttggcctcccaaagtgttgtgattaccagcgtgagccactgcacccggcggtgctttaattctttttaactgactctttccgaggcatggattggcctctccctttgccactccctgaactgcaggtgattagagagagcatggagggggtaggggggaggcagggtggggctgggtacaggactttgatctgaccaagggctgccttggtgatgccacacttactgtctccgctgccaggtgagcccactcaggaggaggacgctgatcagcaggaaaacacagccggccactgtcaatagagagagggagttcagcaaagggccctgggcttggcatgggggcagcaggagccagggccacagggcaggctgaggacatccccaaagagcaaggcggaggctgcagcctctcttccctgtctcaggaagtaggtccctccccatgggatttcctaggagtcttgaggaacagggcagggaggacagggtgagggtggagggagcttcccctcaggaggcacccttctctcacaaaagcccctcagaaaggctcagaggccaggcctcgtttaaggacaccgagagcgcctggtaaaagaaatgttgaaatatgaagatgatgagaagcacattaacatctcctgaaagaggtcgggttttccagatgctgctctgctgaggttttggaggctgacatttgtttactttctaggcagatgcagactcagagtctgtttttccctcctaccaggaaacaatggcagtgtttctggaagcctgtcctctctgactggctacgtggctccttcctcccactcttgacccctggcagaggcccggggtacagcccttccagatcagcttgagaggagctgatagggctgacttgagactttgctcacagcatcctgtaactggttcatgcgaattctgagttacgtcagtatctggattagtctttcactcacacattctgcagtgtaaggaaggggtcctttcagtcaaccaaccaacctaccaatcaactaaccaactaacaaacctactaacctaccaacaaactaaccaaccaaccaatctaccaatctatctaccaaccaactcactaaccaaccaaccagctaaccaaccaaactaccaacaaaactaccaaccaacctgccaatctaccaccctaacaaccaacctaccaaccaacctatcaacttatcaaccaacccaccaaccaacctatcaacttaccaaccaacctatcaacttatcaaccaacccaccaaccaacctatcaacttgccaaccaacctaccaaccaactaaccaactaacccaccaacctgccaatctaccaacctaccaaccaatcaactaacctaccaacatacaaaccaacctgccaaccaagcaaccaaccaactaaccaactaacctcccaacctacgaaccaacttaccaatcaactagccaacctacctatcaacctaccagtcaaccaactaaccaacctaccagccaaccaactaaccaacctactaaccagtcaacctgtccatatctcagcctggtgtacattttgtccacaaagccagtgccccactcacctgctacctggtactctgttgtaaatatggacgtctccatggttgcagccatttctgtctgtatttgaaaatctgtgaaaaagagataaagagagacactcctgctaccgtgactttaggacagcacgaggctaaaggaagtcagggtgtctctgtgaatgagaagctcagaggctggtgggagacacgtggtggtggtgagggaaggtgttccatctctgcctggggaccgtgcttggtcctggtcctgggttccctctttctgacacttgctttggggcctgcaggttgctgaggccctgtccctgctcagagggagaggaggctgctgtgggcttctcccctacaggtcacctccgcctatctccctgagcctggctcctggtcacctctgcccttttggactaggcctctgtggtccagcgtttgtcttctcccgcacctgttgttgtgacgaggcaggaagtctcactctcaggacggccttcggggcttgcctgaggcttctcttcacctgggggagagagtaagtgatgctggtggagctaaacacaggagtcagggcctcactcccaccccgcctgccccaggcagccggccccagacacgcccgaggaggcaggaatcctggtgtgggcacttcgccagggatgccacccctcatggttccacagcaggggcactgggaagcggtgaagtggtctcagcagagcagacgaggctgaattctaactctgaccctagctgtccccaaaactctgagcaatgctttctccccagcctccctccccagtcctggtttccatctgtgacttggaaacaggtcataataatacgaatgccattgaaccactggatggagcagagatgcactaagggacagctgcttctgtgccaggctctccacttctcctgaggggtcagcaaccctggctctgccctgcctctcaccctcttccaaggaagcagcaagcattccctggctgtcagggtggcccagggaagcagctaagggaacaaaacagcctccctagggaacccaagagaaggacatggagtatgagaagtgcagtgagcaagaaaaccaggaatacttgtggttgaatgtaagtcactttttttttttgagacggagtcttgctgttgcccaggctggagtgcagtggtgtgatctcagctcactgcaactccacctcctgggttcaagtgattctcctgcctcagcctcccaagtagctgggattacaggcacccaccaccacgcccagataatttttgtatttttagtagagacggggtttcaccatgttggccaggctggtctcgaactcctgacctaaagtgatctgcccgccttggcctcccagagtgctgggattacaggtgtgagccactgtgcccagcctgcatgtaagtcacttttgattgtcgtgatactaataagatttcagaaggaagacagcaggagacctcgacatcggtgggctgagcatttgcatgagtatgtgtgtgtgtgtgtgtgtgtgcgcgcatgtgcactgagtaagtcccgactctgcacattttatgtttatttttacaagctcagctggggaatggcacaaggggaaggaacatgctgaccgtggagggctgttcagatcatgcatttacacgatcaccagtaagaggaaaaatgtgtgagtgggaaactggacttgcccttggagccagaggaggccttggtggcttagagaagtagtggacttaggaccaactacgaggcagcatctagggtgcttaggagagggctttccttctcttctgtctccaacctttctccccactcagggcacagggggaccttcattgaaggagcccttagagtccatctgatctggtctatttaaatttttttttttttctcagaatgagaaaaaatggaagcccagggagatcaagggtcttgtccaaggaccactcttgtccagcaggagtggtcagggattccactctggtcagcctgatggagcaaagcaacattgtggaccccagaagggagccaccctacctggaaactgactggtctccatttcacctgtgcatatgagctggggctgggtccaccttgtcttcccgtgggtcattttgcagacgctctcagcaggacctctgtgtagagccctgtatccctggacgcactgataataaaccatctgccccaccacgaaatgataaattctctctgtggcttcattttcccatggtggaggttccctgcagtgacctggaagatggaaggaatgctctgaaggcaagttggggacagcaccgcgagtgagtccaggttgcctcttgctagggactggaccttggttcttactctcttgactgcttgctcatcctttcattcaaccaatatatgttgagaacgtctgagcgtggggaagtttgctaggccctgtaggaaggcacgaagaccctgtcactcctgcaaggggtggacagtggattgggtaagaaaggcatgtgaaggatagcagacgttggcaatgggaacacagaggaatgagcgattcattctggttggtgcggccccgagacaggaacgccacaactgcctcttggaagacagtgcaggtgttgacagtggacaggagtgggcggggcagtctcagctgagacacaagggtaggctcaagcctatttgggccaatggagcatgaagaccaccttggatttctgctggacaagtgaggaagtgcattcttgggggcagcggctgggcatcttgggatgatgtcggaaggattggggacaacaccaaagccaggaggagggacgggctgagggaacctcagagaaatggagcaccatctctgatcaagccacacctgaaggttgacacacatgcgccctttcaagacgtctcaaaatttcccatccccagaactttccactcacccaactacatcccaggcctgacggacctgtggcctgagaccatgtcttgttctgattaaatctctgaattccccacccacagcccccaacctggacatatggaattgtatgtgccctctaaccccagcctgtgaaactgcgcacgtgctctgaacttccagactctccccaaccctgcatacccaacagagcctctgtaaatatcctccagagcctcttccccagcaggaagctgggtggccctgtcccaggctggctcctgccatgtggcaccttgaacatcacgactgaacttgtgttttggtctcaggataaaaggttgtttgacagccagtacaattcgtaactgtctgaacatgtttgaattgggtttgcttctttccaatgaaaacacccaaactgagacaatctttgaaacatccctcaggcagagccagccttcgagaaaggacaacaagcattggcctctttgaagccttccaataactgtgcagggtgatatgggggaagtagaacaaaacaaacaaatgtgcttggaaacaccattccaggacaaagtcggaaggggaaggagtaagagcatcatgttgcaactgtgcccctagattagtctgttttaaaaaataaaataatggaagctgtaagtaaattcaaactcttttaaaataagtaatcagcagaaagtttcctcatctaatctgggagacctgaggtctgattccagccctactatgtgagcttaaccaaatctttttatcttttgtgcatctcagtttcttcagtaagttgaagtaacccttcctggtcctgactcattgtatagccaggctcaaatgggatggtatctgatacagttctttgtaaggttgtaaaatcagcaaagggctctgaagtctcctaaggctagcctgaccttagaaagctcaattcttcctagcaggttctgtgggttttttttcttttttgttttgtttttttgaggggggacagagtcttcctctgtcactcaggctggagtgcagtgatgcaatctctgctcactgcaacctccacctcctgatttcaagcaattctcatgccttggcctcctgagtagctgggactacaggcatccaccaccatgcccagcttaatttttgtatgattgtagagacaaggtttcaccatgttggccaggctggtctcgaactcctgacctcaagtgatctgcctgcctcagactcccacagtgctgggattacaggcgtgagccactgcgcccagcccattttcttgacaccataactgaatcccaattcagtcgtgggaaagcagagggcagacaagggacagccacagtgcccactcatgcacagactgctggccaggacacacgcatctggagcttttgagactcacaagtgtggcatgcacattttacaaccttgccctggaagaaatactgggaagcaagtaatttttttgcggtgcgttgtcttgtgcttaaggggaagacgcagagcgtttccttgagggcagggatcgttgtcacactcttgtttgtgtcttctatcagcagggcctggcacacagacccaacagacgcttttaagttgagttgaatttgggttgaattctatttggccagttaccaaaccagggagtaagcccagacctggattggctgccgtcagattggctttagttgctgagcaaacagcctctgagcaactctgcactaattcttgtctgcaatgatgtcttgggaggacggagccacatgcatgtgtttatagaaggcagggcagaccttcttcctttgggtacacatcatctgcctgcaggagaagggtgcgctagcaggagttagctggaggacagattcatctctcacctggaaggctcgcttggtccactggctgcattggactttgcatttctgtggttttcctttctttctgttcttcaggttgaggtgtcacttgtttcgttgtgttccgagtggctagaaaatatagatggaatgatgcagataatttcacaaatgcttcatagaaaacactgttcatgtattcattcacttgagaagcacacctgtccagggcccacgatgtgtctggtggtgtctggctgctgagcttacaaatacgaaaccagagtatgccctcccagcaccggcctctgggtattcaagtgcatatggcaatgcccacgacatgtttttgagcgtgtgtatacgtgtctgtgcatgtcatgtatgttacgtgtctgtgtatgccatgtatgttacgtgtctgtgtatgtcatgtatgttatgtgtgcatgtgtgtgtctctcaccaaaagggactccttgcttgctgtcaattgtctctgtgttgtttgacagcagcaggagtggtctcactccacaacacactgatcctttgctccctaaggctgttcagaatgcttgaagttagagacgccatcttaacacaatgacaaggaaacttctagaacagccctctctattgtgaagagtttggcaaaggagttgagtctgagtgccccagtgaggggggtgatcagtattccagctcaggataaaagagggtgtctaggtcaggtgtggtggctcacacctataattccagcacattgggaggctgaggcaggaggactgcttgagcccaggagtttaagaccagcctggacaacatggggaaaccccatcactaacaaaaaatacaaaatattagccaggcatggtggtgtgcgcctataaggcccaggcaggagaatcacttgaggccaggagttcgagaccagcctggccaacatggcgaaaccccatctttgctaaaaataaaaaaattagccaggcatggtggtgcacacctgtagtcccagctacttgggcagctgtggcacaagattcacttgaacccaggaggtggaggttgcagtgatctgagattgtaccaccgcaccccagcctgggcaacagagcgagactgtctcaaaaataaaaataaaattgtgtggccgggcactgtgactcatgcctgtaatcccagcattttgggtggctgagatgggcagattactcaaggtcaggagtttgagaccagcctggccaacatggtgaaaccccatctctactaaaaatgcaaaaattagccaggcatggtggagggtgcctgtaatcccagctactcaggaggctgaggcaggagaatcacttgaagccaggaggcggaagttgcagtgagccgagatcgcgtgccattgcactccagcctaggcaacagagtgagagtctgtctccaaaaaaaaaaaaaattgtgtttagtgaatgacttttcaggaaccactaaaattagttatcctgtagactggactggcccatttgtgtctatagggctgagtgaacaaaagctgggctctgtctcactctttgctgcagttcttttgttcttggtagtcacagaagggacacttaccagagcttgtgcattgacattggttgtcccaggacgagtggctagagtttcctgtacagagcatatagagtgacccgctttttattctgcggaaacctctcttgcattcacagttcaacatggttccttccttgtaggccatggctttgaatgtggcgtgtgggatctctggcgggtcatcgtcacagagctctgcaaagcaaaagaagcctattaggaactcaagaggccccaggcaagtactcacatatttaatcctataatgacttaatcacatatttcttcactttatttaaaagatggtatgccctactttttgtgagaaagcaactaaggctgctaccattgttctttagaaagctttgtatcagagctggctcaaaaattaactacaaccaagctcctctccaaagcacaatgtatttcaaactagatgagtagaaattaacaaggttttattccgaatatgcctcatgtcaagcaagtatggagagaggagggtcaaggaatgtgaagaaaggaagaagcaaagttacgtacatttaattgaggggcaaaatatgtctgtgcaagatacttttaaggatatacgagttgttagactttctataattaatgactgtgcgccattttttgagaaatatacagaaagtgcttcactcaatgtctggcaaataggaaatgtgtatttctcacccacctgcccacctctgagttcaccaaataccttcttatattatgaagaccttagcctccctcagcctgaaaaatggactctggtatctcactaaaggcaccagaagcagtggtcaaacatcaaactattaaaaggaaaagtggcacaggtctaatcagaaaaataattccattgcctactttgcaacaagttctctgctctaagagattagattttggggggaaatatcacatgctggataaaggaagtggacggggagatgacagggacaggaagaggcaggaaagcaggagtctgtggcctctccgtcaatggaagcccacacggaggctgatcagggctgctggctgtacttatggctgtgggttggccggttgtgtattggtcattcaggttaagtgaagcttctctgtgcccttagactctgcccagcaccttgtcctccggaagaccatccccatccaatggctcaggactctcctgtctcccctaagaactgaaggtagggaggctgggtgcaatggctcatgcctgtaattccagcactttgggaggccaaggcgggtagatcacatgaggtcagcagttcaaaaccagcctggccagcatggtgaaaaccacagtctctactaaaaatacaaaaaaattagccgggcgtggtggcatgtgcctgtggtcccagttacttgggaggctgaggcaggagaatcacttgaacccaggaggcagaggttgcagtgggccgagatcacgccactgcactccagcctgggaaacccagcaagactctgtctcaaaaaaaaaaacgaagatagggagaaatcagacagcttggcccatctctaaccaacaagggactaagcaaaagcaatttaaatgggctccatgggccagaaattacagtggaacaggcaacataagtgctcaataaatgctggtaatctcatgataaggcaagagcagcagcatggtgggaaggagaaagatgggtttctaacttctagctccagcagcttacaagctacatagttttattattttacttctctaaggctcagcttcgtgctgtaataattattattttattgatttaatgattatagcaaataatatactaaggtaacttgaagaaagcctggaaaataacaggtatggaatagatggtagttctgttcctttcctttttctcactgtccagaagaagagaatggtaattcagatagagactggactgaagtttaccttaacctttaactcctgcaaaagtttgtctctctgtacttctcatatcactggtaccatttgttggcacttattatggatcaacaccaaccaatattttaagtatcagaagataaatctgttactaaagcaagacatggataataatcagaaaaaccagtgaagacttctgcttccagccatcacagagtaactgggaccaaaacttacgtttctgctgaaacagctgtaaaaccagtccaaatgtatacagcaagtgctttcaggtgctgaacaacaggcagctcagggctacatgattttggaggagggaaacacgtgagaggcgcccacagttgccctggcttccttcctggggtgctttccttcccggcagcacccaggtggaacccaagcagagtggtttcattgacgtgacatgactgggatttgtggggtggggctctggagaggacactgcatgaaggtcgccccaaaattatgtataggggtccacctcaggttcttagccaagagctggtctgaacctgaacagggcagaactcagtgaaacttagccctgattgtccattgtgagggctgagagaagaagagttatgctaagttttatttataaaaacaggtgtctgagctgtgggttgtagttttccaatcctgctttagagaaagaggcatccctaggatgaatttcaaaaccaaaatagacctgcccttacaaagattaaaaccaagcctaatagacaagaggatgcgctagtcatttaactgcctggcagagcaaaatgcattaccttttaaaggaccataagataatctagaccctttataatgtatagctcataatatccagcaaattaaaagaaaatctagacatgtgaagaaacaggaaaatgtgacatacttgacctactcaaaaaagtgctcaatagaaacagacccgtaaaattgggtgtggtggctcatgcctgtaatcccagcactttggggcgacaaggcaggcggatcatctgaggtcaggagttccagaccagcctggccagcatggtgacatcccatctatactaaaaatacaaaagatcagccgagtgtggcagcgcatgtctgtagtcccaggtacttgggaggctgaggcaggagaattgcttgagcctgggaggtggaggttgcagtcagccgagcaccccagcctgggttacagagtgagtgagagtctgtctcaaaaaaaaaaaaaaaagacccctaaaatgacctagattttggaattagcacaaaaggaatttaaaacagttgtaattacactcaatgacttaaagcagaggtcagtaaactatgacctgcagatttgctgccatttattttatttatttatttatttatttatttatttatttatttatttatttatttttgagacagagtttcgctcttgttgcccaggctggagtgcaatggtgcaatcttgactcactgcaacctctgccccccgggttcaagcgattctcctgcctcagcctcccaagtagctgggattataggtgtgcgccaacacgtctggctactttttgtgtttttagtagagatgaggtttcaccacgtttgccaggctggtctcgaactcctgacctcaggtgatccacctgcctcggcctcccaaagtgctaggattacaggagtgagacactgtgttcagtggtttatttttataaataaagttttattggaagaaagacacacccatttatttacattttgtctatggctgcttttctgctataatggcagagttgagtagttgcagtggagtaacatcgccaggtagcctaaaatatttactctctggccctttcagaaaaaaaattgccaactgctaatttaaagaaaaaatggttataatgagtgaaacaacaggatatctcagtagataaatgaaaacttgtaatttttttttttgagatggagtcttgctctgttgcccaggctggagtgcagtggcacaatcttggctcactgaaacctctgcctcccagattcaagtgattcttctgcctcagcctcccaaatagcttggattacgggcacatgccatcatacatggctaatttttgtatttttagtagagatggggtttcaccatgttgaccaggctggtctcgaattcctgacctcagatgatccacctgccttggcctcccaaagtgctgggattacaggtgtgagccaccgtgcccagccaatatttttaaacataaaaaattaaaactaaaagttacaatatctgaaatgagcctagccggggcttgaaggcaaatcaatagaaattatccaaactgatgaacacaagaaatctgaaaaagaatggacctttggcatgctgtaagacaatattaaatagcctaacctacatttaattgaattcccaatgatagagaagagaaagaatggagcagaaaaaatatatgaagaaataatggccaaaaatttttgaaatttgatgacagatactgatttacagatccagatgttcacggcaccaagcaagatacgtataaagaaaagcccatctatatacatcgtagctaaactgctgaaaaccaaagataatgagaaaatcttaaaagtggccagagggaaaggacacgtacctacagcggaacgatgatgaataacaactgacttctcaacagaaacaatagaagcagaaaataatggcacaacatattcaaagttttaaaagaaaaaaacccgtcaaccttgaaatctacctagagacaatatcctctaaaaatgagggtgaatttagtatattttcagataaaagaaagcttagagaatttattatggcacatctgcattacactaaagaaaaattttcaagcaaaagagaaattacactagctagaaacataaatcgacatgaagtaataaagaacacgtaaatatttagataagtgaaaaggccactttttgtttttaacatctttgaaagacaactgtttaaaacaaaaataataatatggtatggtgggttctgttgaacatgtaaatgtaaaatatacagcagtcctagtataaaagttagggagaatggaattgtactgttttaggtttttatatcatatagaaaatggtacaatattaagtaagtagatagtgataagttaaggattcatgctgaatagcctagagaaaccaccaaataataccacaaagagtgtagctaaaaagaatattaaatttgtttggttagccaaactgaagagagaaaaggaagaatagagtaataaaaatagaaaaggaacagctaagaaacagatagcaagaaggtagacttgaagccaaccctatcagtaattacattaaatataaatggacaaaaatccatactttaagagatagaaactttcagactggattaaacagcagggcccaactatatgctgtcttcaagagaacacactttaaatacaataaaaatgatgggttgagaaaacaggatagaaaaagatataatctacaaagataagcataaggaagctggtatggttatattaatatcaggaagtagatttcaagataaggaacattattctcagataacatgattgtttacataaaattactgagggatctgcaaaatggctaccagaatttagcaagttagcaatttcagtatatatatatacatatatatatatatatatatatatatatatatatatatgtatatatatatatatatgtatatatatgtatatatatatcacttgtagttagttctatatactgacacaaccaattagaaaattaaaaatttaaaaacaattgtatttacaattacatcaaaaaacataaaatgtttgtaaataagcctaccaaaaacttgtaataccactaaactgaaaactctgaaatattgctgagacatattttaaaagaattaagcaaatggaaaaatatactatctttatagattgtaacattcatttaaaaaatctattcaccttaaattgatcaattaattcaaggcaactacagtttaaaaatccaacacaattttttagtacaaatttggaagttatttctaaaagctccttagaaacacaaaagacctagaatatctaagacaatcgtaaagatgtatacatttggaggattcatgacatctgatattcaggctttctataaaactatggaaatcaaggcagcgtagtattagcataaggacaaacagtaatgaaacagagcagaaagtcctgaaatggactcaactcatgtttgttcaactgctttttttttaaacaaataaatgtgccaaggaaattcaatgagaaaggaaaaatcttttcgacaaatgcttctggagcaaatggataaatgtatgagaaaaaaactcacatcttatgcaagaattaattttattatatatataaagataaagatctatgtactaggtctatatcttatagatgtaaccataaaaggcaaaactaaaaagatttcagaagaaaattaaggcaaatgactttgcaagttggagataggcaaagattgctcatagaggatgcaaaagcactgactataaaagaaaaaaattgagaatgtctactcatccagagacattaagaaaatgaaaaagtaggcagggtgtggtggctcacgcctgtaatcccagcactttgggaggccggggcgggcagatcacaaggtcaggagatggagaccatcctggctaacacggtgaaaccctgtctctactaaaaatacaaaaaaattagccgggtgtggtggtgtgcgcctgtagtcccacctgctggggaggctgaggcaggagaatggcgtgaacttgggaggtggagcttgcagtgagcccagatcgcgtcactgcactccagcctgggtgacagagcgagactccatctcaaaaaaaaaaaaaagaaaaaaatgaaaaagtaaatgatagactgagagaaaatatttgcaatatatatatttgtcacaaatacttgtgtccagaatatataaagaaaaacaaagcaagagtaaaaggcaaacagcccaataaatgggcaaagacttgaacaatcacttccccaaagaagatacacgactatcaataaacacttgaaagtgtatttaacatcagatatcaataaaatgcaagttgaaaacaatgatgagatagcccattggggaaatggaggaaatggataaaagactgatacgtcaaatactggggaggaagtagaactaccagaactctcttatgttactggtggcagtgtaagtaatgtaattactttggaacactatctgaaagtatttggccaggcatggtggctcacgcctgtaatctcagcactttaggaggctgagacaggtggatcattttaagtcaggagtttgagaccagcccggtcaacatggcgaaaccctttctctactaaggaggcagaggttgcagtgagctgagatcacgccactgccctccagcctgggcaacagagtgagactctgtctcaaaaacaaacaaagaaacaaacaaacaacaacaaaaaaaaaacaaaaaaagaaagtatttttattgacgttaaatatatacctgccctacaattcagcaattctacttctaggtatttatctaagaggaatgaagggatgtgtctacagaaagacttttataaaatatttatagtaacttctttcttttattaagccccttccattctagtacatagtagctttattaataataaccaactcaataattcaaacatccatcattgggagaacagacaagtagcttatgatatagtcatactatagaaaccattcaaaaataaaaaataatgaactattgatacaggcaatattgataaatctcaaaaatgttatgttgaacaaaataagctaaacacgaaatagtgcatacactttgctttcatttatatgaagttcacaaaaagacaaaagttatatccagagatagaaagcagacagtggtttcttgtggtaggtgggtattgaccagaaggcagaagtgatgaaaacgtttttgcagctgtacacatttgtcaaaactcatcaaattgtatgccgcagatctatgcatttctttataagtaattttagctcaacaaaatgagcgagaagcatatttagctactcttttgtaattattcattagcacaaataaccaggattgacctcagatgtttttggaatctgagatgtcaatcacaagccaagaacatttctaaacacatcaatttgaaaagaaggaaacaaattgtcttggaagctattttgtgcccttagaaactcttgaattccatgagagtgcgtttttctagatgaggtcatgggcattttcagagtcatcataaattagcccgagtgtctgaagaggtcatgcggggacaaggggaagttccagaacttcttattctcacagactttcctttcataaagaatctttcctggaatttaggatcttgacacctccaggtctgtagctcagtaaccactaaagagcttggctataatccttttccctgaaaggccttgtcaggaagtgccaaacatcacctgaaggcagcaggaggtagaagagtgtgtggaaaggtacgctggagggttgctctttttcaatctaataggaataaatttgggattttttttttagcccttctcagtgtagtgttataaaagcagcaacagaacaacatccaaaaaaagaataaaaaataatttgtctaaaagtcttgcacagtaataacaggaggattccacttatatgactccaaaatgttgaaatcatctttccctatattatcattcttttattttttaagacagcatacaactgtcctcattctctagttttactcactaacaatgccaaaaattacttctcaaaattcagctaacaagggcttttctctgcctttacacttcctcctgtctttccagacccacttcctgcttctcccaatgggtcttctcaacataaatcattctctcccggaatattttccaattcctagctctacgcactcccccagctcacaccaagggacctgggagcttgggaggcagacagaattttccttagaagaggggaaggggaatatttttctccctgtaattttaaagtattggcacgattctggatgtagacatcaccttcttttctgagattatttgaagtgtctggtgcctatggactgtgggaaaatttgagatgatcaattcgggagttggaggtgggggtgtagggtggtaaacactcaaggcttagaaattggggctccccaccctgcactagggtctcacacaaaggggttggcacagggctgagaagcagtggggctcctgtccaccctgcccagcacctactcccaccaggcaactgagtggtatttagtctgcaagactagcccagaaacttgaatgggaccctgagagagccaggggttccttgggcccccgctaggggactttctgtttgccctgggtctccctgtgtgggcagggatggagagtgagggcctgccttcatggcagtaggctctgagtgggtgactggcgccaggccaagttctaggtgggcttcccaaagccacattcaggcaggacggagctgctcttgcacacggtttcgtgggctggattttctctgttgcacacatgcttagtatctgtctctccctttgttcctgagtggtgggccgcacatgaggctctgagcaggctatatctctattctggcaataaaagtactctggacactgttaaggtgagaaaagaaaagaaatcggggctcccaggaggagaatcctgaaccacgggctctgcggtgatgtggccttcctctttagtttttgtgccttttatgtgggcagagggaaaaagagacagccagcagtgatcattaatcctgaaaatgccgagggctttggcctgggacccacaccaagacagagtcaaaccgagttcttctagtgttgagcgtgtttcacatcttccgttggagtttgctgtggatgctcattagacagacatgggcagaatcccacttgttcctcgtccttttccacctcacctccatcattgtggctgaaatacacgatcatgggtgtatctttccttgtggatttgttgcctctaggagttctgtatgcagctgaagggtaacatcccttgggagcttttgccttgtctggctgacgccttggcaatcgcaagtgacagtgacggagagccacctcctctggaatgcatcatggaacaggtctgggagaacagagggtgcaggtgaagggccctcgacaatgcttctctttgcattgtggggtttccccttcaatggattgctaaagattcaacttctctgtctctttgtgtgcccgctagaaagggaaaagccaggcatttgtagtcctcctgccacagatgaccagaatgacctcacccaggacaaacggcgacagatttaggaattcaagccagcttttctgactcccaggcacctgctctctcctttcgagtgttcgactccactctcagtcactcgtcactcttcccagaaggacaaatgtgcagcttctatgtcttggatttcaaataaaagacgaggaacttggtgaaatgaggtggtctttgccttccgcgtcactctctgctcctcctggcaagaggccccatttttcttgccactgaggttaagtgaaaacaaaacaaaacaaacaaacaaaaaagaggccccattcacagtaaagataaacagcagcctgggcaggccagcggctcttccctgacgtggaattatgagccctctttcttcgattttgccacatacccgcagctgcactcccataatctgaaagctgtccctttaatttttaccacttcattattagaattggagtagaatgaaaattaatttttccctgagctatttttgtgtcccttgagttaaccagaaataccaaccctggaaagagatgtgggggacagtcattttagagagcggacaccactgctgaagaagaaggatatcccggttggctgctctagagccggcaggacggatgctgaggttgttcgcagcagcgtgtgtgcagagcccccgggatcttgcagactgggatttgtcagggcaggtgtggacattgaggctatttctaacaagctcctacatgatgctggggctgcagagccccaggccgcacttggagtatgagagtttccagggagtgaagccccggctgctctctctgccccctctccatctgccccctgggtgaggacaggactcccatccctccagtgcacagtgagtgctgctcaatctgcatccacagcggtttgtgcccagatgcttcctcactcagcgtctaacagggtgcagtggaaacgtcattgactggaggaaaggtgtgtgggtgagaaacgtttgtcggttgagtaactttttgtcgttattttttttctctgatgttcaaagtaagagaaaactcatctggcccctggagcccatgtgagcaacatgaaagataaagggaaaagggggctgataaagatgtggaccgagtctgagataagattctttgccccttgggtgaatccaggtgaagttgttttactcttagcccagccagccctggataaaggcttcatccctcttctctttcctgtccatatatcagaactttaagctctacttgtacccagtgaagattagaataacgcacggagcacaggaaatgtctaggtgatgatttcactgagctttacaagggacacaggtacgcatcaagagcttgggccactgggtaaagagggatctggttcttgctctaacgcggttcatcttctgtgtcagaatcagatagattctgggtgtcagagacccgaatcttcctcttgttccgctcactgcccccctgtggccccttctcatttcaaatgctctgtctgtaatatgaaatgaaaagaattcctcccagacccctagccaaatttcaccttaagctcgttgactcccagaggaaatctctgtgggagactggaaagaggacgctggagccagaggctatctttgatagtgaggtgaggtttactgtttaataagaactccaaagatatgcctaatattgaaggttgtctctcgcttccttgggaaacccaaaccagaagtttaggccgtatagaaagtaagtggtttgggtgcaaaagggatgtagaacatcccttttaatggtatcatagaatatgagaactagaagagagctcaaagatcatttaggccaacctctacattttatagataagaacactgggcctgtggtcattccacaagtttgtggcaagccttggattacaacagatcaccaggttccctgactcctagttcagtgcttttccaacacccagaatcataatcttcaggaaggagcgtgcttttcacctatctgttgaaggttatctcttacaaagaggtggagctatgtctaaactatctgggtgctgggaggtgtttgtgtgatgttgtggtttagttcagattattatctttgaagaagtcagagggcccaggccctccatttggggttatctatataataataactatgatgtctgagccctgcctatgtgctgcttctttgcatatattaccttcaatgctcaccatggctctggaaggtagatactgtcatccccactttagaaagcaagagattgaggttcagagagattaagtaagttggctaaaccacacagctcaaggtggtgggacaggagtcacgtgaaagtctactattgctgccctcatgtcagccttctaaaaaatctcacttttactttcaggaaattctttcaaatagcaaacataaatgcgcacaaagaagcaaggaggaagaggagggaactgtgtagaaaaggtttgtggaggcaatttgttctaaggttatttattatttgagaggaaggctatgatattggttaaatctaggctttgtaaagtctggattcatgttaagatgttaaaaattacatctaaaatgacagagtaaagtgaataacttacaagctattggaagaaaataaaataggataaaaacttacttaaatcaaaagaagggggaaatgcatagaaagagaaggtaaaaaataaagaacaaaataagacagtggaaattcatcaaactatatcagtaataattatcaatgtggatagattaaccctgcagttacagaatgttggactgcatatatttttaaaaatatgcagttatatgatgtttataagagacatgcttaaagcataaatgctccaaaagtttgaaactaaaagaatggacaattgaatccaaggagttatattaacatcagacttcaaggcagaagcattaatagaaatacagaagtcagtacgtattgctaaagattcaattcaccaggaaaacataaaaatgctatatgtgtatgcactcaaaaacatcacttcaaaatatacaaatcaagaatcaggaaaacataacacttacgtacttctatgcacccaataacataacttcaaaatacacaaagcaaatattgacaaaacaaggataaatttagaaatctactatcataatgagaaattttaacagtgtcttcctttatgatggataggacagacagaaaatcagtaagaacaatcaaatgtgataaccacaattaacaaatttgattccaacaatagcagagcccactcttttttcaagcacacatgggacatttacaaggcagtagaggagttgaaggcaagttaggggcaaagagtgggtatctatggggtaggaaaatggaagtctagataaggaataaacagaaggaaatgttgaaggtaaagctctgggtgtcagaatcttcctcctctttcactcactggctcactgtggtcccttctcatttcagatgctccgtctgtaacacgaaatgaaaagaattcctcccaatcatgtaaccataggagcttctcatacaccccaagccatttccttttaccatgctgatatgtccttttaggcctcttgacatagtaccccttgctgggaatcctgcccctgcccatgagccaggcaacagaatgaaggctgctcttaactataaggtgcctgaaaggtgggtgggagttcaactggaaggttaggcacgtcaggccattctggcagagaatgtgtaaaagtgtaaaacagcatcatcatatggaagatacaagagactacaggtagaatgttttgctgaagcatgaatcgtgagggtatgaaggatggaaatatgaggatcagttgaaataacataagtgacattgaaatctgtaaaatgctccacaaattttgattgttgctacaatgacctcttgagcggtgttgtttttagaacccaatgataaaatatatagttactttctaagctgaaaaacaataattaaagcgttcattgcttaaagcttgattgtgtcacaacgaggaaatagagtttcttttgaattcatattctaagaactatttatgagaatgctgtattcggttgtttcctgtcacctgtattcacattaatagattataacggatttcaatctactgaagcatagtcaattctctgattgctgccaaccaaatcaccatggttgaatttgaatatttccagtcatttttgatggttgttgcctgcccacattacctgttatttatttaaactaccttatatacgaatacacttttatatataatttagaattttttcttagccatcattaaatcacacctaaatttgcaatacatggtattgtcttagttgttcactttgccttttgtctctcttttcctaaacctaccttttcttccccaaagacactcaaggacttaatggcatctttgggtttttctcactccaattgactttaaaagaaccctcgttattagtgatctgataaaactggtaacatagataaggcatacaattgttggaaaaagagaagataaaaataatcattctatgtgaggaatttaattaagtacttagaaaacccaagacggttaaagtattagaactattaagagtttcataaggtggccagatagaaaattcatttataaaattcaacattttttatatatcagcaacaaccaatccaaaaatataatgggaaatgatattttttaacagttgtcaatccttagttgccagaaatgtgctaagttctgaacagaagatcctggaactgggagagatgttaattaactgtggacttttaacatcacgagtactttgagaacttaaagggtgagttaattctttttttttttttttttttgagacggagtctcgctttgtctcccaggctggagtgcagtggtgcaatcttggctcactgcaagctccgcctctcgggttcaggccattctgcctcagtctcccgagtagctgggactgcaggcgcccacgatcacgcccagctaatttttttgtatttttagtagagacggggtttcactgtgttagccaggatggtctcaatctcctgacctcgtgatccacccgcctcggcctcccaaaatgctgggattacaggggggagccactgcgcccggccaatggtgacttaattctaaaagtagaattaaaacatataatacacaaaccagtagaaggaaaagagaaaataaaggaaactcaatcaatttaacagaagacaagaaaagataaatacaacagtaaaagaaaaataatggttaataaaagttcaaagtaaaatagcataaataagtccaaatgtagtacaataaatataaatcaattaagcttgcttgtaaaagacagaggtattctgattgagggggaaaaatttcccccaaagtcctgcacaaggtctatttttgttatgtcaagagacgtctttaaaatacagtgacatgtgaaggttgaactaaagggctggaaaacacattatatgcagatatttagcaaccaaaagaaagctcgatagctttagtaacaggagaaactagaccaaaaaagtattttcacagataaatatcactgtggaagttataataatcttgaccctgtaaacactcaacaatacatattgttgataaggtagccagatataagaaagctccatagctacaataacataagagaaactagatcaaaaaggcattttcacaaataaaaattattctggaagttatgataatcttgaacatgtatacactcaacaatacatatggttgataaggtgaagaattacaaaaagaaattaattctacagtcaaactggagaatgttaacacatttgcacctgatgctagcaatgtattaagcaaaaaaaaaaaaaaaaaaaattctgatcagtcagagtttatcccagcaatagtgaatggtttaacgttagaaaatctctcaatgtacttaaatacttttatggtataaaggaagaaaacctacacaatcattttaatagatgaagaagagcatctaatgatgatgaaaagaatatccattattgattaaaagaaaaaaaacttttaaggtagtagaaataaaaagaaacttatttaaccaatagacagtagacactgaaagcttacagaaaataacatgtacgtgataccttaaaagccttctatttaatggtggaaacatatacaattcctgcttttattctatactgtattgaacaccccagctaatgcaatggaacaagcaaaagaaattagaggaataagaagtggataacaaaaaataaaattgtcatttataagtaataacgtctacttagaagatccaagaatctatacttatccaaagactcagtatccgtaatacataaggaagacttacaaatcaataagttaaaggccaacaacccaataaaaatagggacaaaggatatgaacaaggaggccacagagatgaccaaaaaaacatgtggaagcattctcaatatcaccaggtatcaatgaaacttaagatagtaatgagattttattttatattatcagattggcaaaaaatgttaaaatttccctatggtaagtgatgatgaggaatatgtgaggaattcaggaaatttcataaattgctgatgaggattataaattagcatagcgatttcaaagagaacattttaaatatagcagtaaaattgaagctgtccatgttctaggatcagtgatctcacttctaggtatattcctagagaaattcttgcatatgtgcacacattcaaggctgtttattagagcattgcttgtaatagggaaaaatcagatacaatctaattgtccatcaaaagaaggttagattaataaacttggcattatcaagaactctgtattattatacaatgtaataatgtacagttgttaaaaagaataaacatcaaaaatgaatctcagaaacactgctgagtgaaaaaagcaaagttgcaaatagaaacagtatattatgcatttatgtataaaataaaaaacaaaccagtagtgtatattgcatcatgagatacagcccagattcaagagagcaattactggaggggaagaatgagattgggttggaccgagagggagctccactgtatctacagcatgtatttatttgtttttgtttgtgtttgttttgtttttttttgagatggagtcttgctctgtcacccaggctgcagtgcaatggcgagatctgggctcactgcaacctctgcctccaaggtttaagtgattctcctgcctcagccccccaagaagctgggattacaagcgcctgcatcacatcaggctaatttttgtatttttagtagaaatggggtttcaccatgttggccaggctagtcttgaactcctgacctcaggtgatctacctgcctcggcctcccaaggtgctgggattacaggcatcagccatcacgcacgacaagagcatgtatttaaaataaacaaaaaggacatgaaacaaccaaggtaaactgtaaacatttactgaatcctgatgatgggcacatgttggttatattaatctttgtgtttttctgtattggttgaaattttaataatttttaaatatttatagaacaaataggtttttcttgacaacctcccaaatgttaattctttaccaaagcttcttccaaaggaagtgattagttcagggccttttccttctgtctgtggatgtggaactttatcagagaaagaaacccccctctccccaaactcagtggcaagtccacagcggggaaagtctaactcccaattttatttatgaagtcaatcatccaaatcacctctcagtcctcagcagctgaattcaacacaatgattaagcctagagcatcttcctagagaaggtggtagtgatgcaggacaagcgagccccgaggtggggcttagcccgcaagggttcttggctttgcccaggaaggaattcaggggcaagccagtggtagaataaaagaaaacagctttattgaagtggcaatgttatagttccggctgtgctacagctccgtgactgcttctgtagagcagggcgaccacataggcagagagtagtaggtcagggcagttttgcattcatatttatatctgcttttaattacacgcagtttaaggggcagtttgcagaaatttctagggaaggggtagtaacttttgggtcatccggtcactgctatggaaaggagcaggaacgcctgggtgttgccatggcaatggtaaactgacatggcacactcatgagcatgtcttatggaaagctgcttctgccccaatcctgtttttgctagtcctcaattttgtccgatgtctgagccctgcctcgggggttgagtcccaacttctacctcagtaggaagatttttaaatggcataattacagagatataaaatttatgtatgcatgtgaccagaggaaaaaataagacagtgcaaaatataagtggtggtatagggacttcacctcccactccccctccacccactctttgctggatcagcacccaagagcagagcacaagccttgggccatggtaggttctgaatgagtagttgagtgtattagcattagcactggtgctgttacccattgattggttcattcaagcaaacattcaccttccttgtttcattcagcaagcacaaatgttgaaggaaatgtgggagaagtaaagtgcctgtctcagggcttgggggatttaaggaagttgctgtcatcaaagaaaagttgcctgattccctcgggaaaggagaagaaggcggtgtggttcaaggaggagaccttggcttcaaggaggagatctccgagcacttggacacatctctgcagtaattagcacagaagcaccatgagttatttgttatctgacccacagtttctgaggcctggttgactgggtcaaatagtcagagtttccgtaaccctaaaatgagtaactcacagggtaagacccttttggagaacaactgtgccttactcaacacttgttaaacaacaacgaaatgatggggtggtggggtggagggatctagttattttgtctttacttagaagggaaaaaagaagcaggaaaccaaaaatacccctacaagcagctgccgctaaaccatcacattttgggacctcagatgcttctgcaaatgaaatgttgggcgctggttatgttctaatcctgggagtcttctcggtcgacaacaggcttccgggcatgaaagagttaaccacaagctcaccacagaatgtcaacctgattaaaataaaagttatcagatttaaaagggggaagtagaaacacactctttttctttctctgaaatctaaaagcagtttttcctcaaatctttaaaaccaatttcttgggatggagtcatatttttagtagaaatatgctaaattggtgactcccacccacagtcttttctgcaaggagagagactcttctgagaaactggagcgaggagctgaggaaattttcaactcaacggaatttcccctgagactgtaaagaaacacagaataagtaagtataacttacaggtagaaacttgacaagagggaaacagaaaagaaggaaaaagaaaaagtcatcaaaaatgatggcaacctccaaagtcatgatgctaagagtttctcctgggaacctcagtccagttggtgtcaggtgagggccggtcctgttaacacaaatcctaattgtcaggctgaccaagcccacgtgtccagaaccctctccagagctctcctcaggggttcccagcagccaggctcactctgccctgctcctcacccatctcgcaggggaacctcttgtaccccttttccttcctgctctcaagaattcacactccgttttacacaagacacacattgcatacactgtgtgttgttgacagggatcatgccttttcacagacaatgacaatccaaatgtggaaacacagggagaaaaccatgggaagtggggagcactgattgaggttctggggtcctggcgctttcagatactaccatgatctgctagtctactgtgattttgcttaagaagggttcagtagagacaaacagcatcataaaagtgtcaaatccgtgtgttcacagatgctaccccagacatcgggtaagacaatgacatttcaggcactgtgggattgatggagtggacagcatagagcagagagcttacggttgtaggttacgtggtaccaaaagcccatgcctgtgctccagggactgttctcagacacataaatgcaacctcaaggcttttgctgagtttagtctttgtattcatctgtgagtgggtcaaaatgcctgtctgctgccctggccctcttctgcagccatgctgagaggaaatacaggcttgcatttctccagagttccttgaaagcattggtgctcaactatccctgccttaacacaaattcttagtcaacacacaacatttgatctctgatagtttcagtgggtgggttctattcttttcaacagatacctcagggttagtgggggtgagctcagatgctcctgcaatgggcattcacactgggcttcttggagagctgaattccaaggtggccacgtttcctaaggacatgggaacttaagatgcaggcagggatcccatgtcctactggaaggtttaaagacttcctcagcacagtgctgagaagatcctgctttttactcgggtgtgggacaagtagttatgaagccacagaatgttaggactgaaagggacaaagaccctctccatgtctctgcatgcttgcatggagaacatgcattgtccaaggaccctcaaatccctgcatgccctgcgcatgccctaaccctgaggaggtgctgaacccttgctgatgtgcagaaggggttaatcagaccatgtggacacaggtagcccaaggaacaacccccatgccaacagcactccatcccgacctcataccatgtgcacagcacctgatgctggtggggtcaggagtgtggcctgtgccacactcagaacgcgggatgaacatagaggaaacactagaatggcaaaggctggttgtcacctgggggcctcagaagccacggcaccagaggagagctcaggagtcagcctgctccaaagctcttcctgcctgtagcatgcaccctgtgcctccgggccaccaaaaacagcaatcacgtcagctgagacgcaacacactgcatgccgaacacacaggagagctcacacgcacaaatgttctcggcttcccagacaccaatgaaggagcttattatgaatatgaaggataattaacgtatctattattttattagacatcacaattcaaatacaataaagtatataaatataaatatataataaatgaaatatataaaataccatcttagcttatgaaattatcttatatgataaaataattatacagatatataataagcaattagggtatgttatataaaatactatagtatactcattaatataattagtatattatatgataaatatatataataaaagacatcatacactaatagagtataatagtcaatataattaaaattattacttatgcagtaattaattatgaggtgatgtgttcttctcatctccgttctctagaggcaggaactaaggcacagagaggcccagtgacttgcccagagacacacagcccctcagtggtggagctaggacttggacccaggcagcctgacaagtgcgtgctcttacgcacaagtgtctgcctgtcctcccgcctatcctccctcatgtgctggctgcatcctgctcccgtggcccctgaccctcaactgcccttgtcatgtgcccgtcatgcatcacaggaaggctgtcatgggagtcctgaggtgggtggtgataagtaagcaagaagaggggttgctggcgttaagagattttagaagttggaattgccaaaaattgaggctggattattaggtgcatggaggacagcaaggaagaaatgaggattttgcccagatttcctgggcgatggggaggatggggtgccattcattgagatagcaaagagaggagaaagagtaggttccagggagggaggacagttctggatgtgtagactgagcagcctgtgaggcatccacacggaaaggtccgagggaagggcctttggccatgcagactagaagcccagcaagtcacatttagtgagcacctactgtgtgctctggtcactctaggcaggctagcttatgtagccttacagcacccagcagggtctgtgttattcccattttatacgaacagaagctgaggcccaccgaggttaaaaccctaccctcatggacttccatggaggttactcaatgccctatgggtttgcctttctgcttcccttcattcttcacataaacccagtgctttctcttcttccttcattcttcacataaacccaatgctgtctctccaaagtacaagccatgccctgactgagacccctctgggatgttctgttccttccaggacacagtttaagcccagtgacatggggagactccaagacacagctcatgcccaacttcaaaatctctgcttccactatgtgcctgagctctcctgccttgcgggactctgcgtggctcttggagctcaccatgtgttttgtcttgggccttggtcattgtattattcagggaaacagaatttctctagagaaacaaaaccaataggatgtatgtagataaataagagaatatttataatgggagttggctcactcaattatggaggctgagaagtcccacaatatgccagctggagctggataactaggaaagctggtggtgtggctcagtctaagactgaaggcctgaggagcagaggggccctgctgtaagtcccagagtccaaaagctggagaaccaggagtgcaaatgtccaagagcagacgacggatgtcccagcttgaacagagagaatgcaaccttcctctgccttcttgttctattctggtcctctatggttggatgatccccaccacactggtgagggtgattttctttactcagtctaccaacaagaaatttacccagtctattcaattcaaatgctagtgtctcctggaaataccctcacagacacccccagagagactgtttagccagctatctgggcatcccttagcccaggcaagtggacacattgaaattgaccatcatgctcatgccacacttccctaatgcatttctaccttcttaactcctgctttccctggaggtctcccattggctgtcatctttctctgggaagcctccgggactcttctgtctgtgctttgtggcatttctctgcagtcccagactttgctcccttttctttacacggcactcaccctactgtatccatctccctcccaccaccttgctagtgcctgcacagaatggcatgcaaaggttttcgtaaaggaaagtagaaattcacaagttcaagctaggatttgaattcaagctgtcaactttccaaattcataagacttttccattctctcaagacgcttttctggttgggaaaaattccggtaggcagacaagatggggaagattgttccagtaagggaggagggtgttcctgggagtccagctttgaaatcacaaatgaggaggttccctttgaaggacaggaggagacctgctggccaaggcgtgctatgtgctgagggaacagtcttggctggggagcatgttgtgtgccaggcagaggaggtagcaaagtgcccctgaggcaatggaaatgactggagctcttgcagccgaaagggcatcacgacaggtgctttcaggggagattaacttggggatgaataacagggtgactgaaaaccagagcttcagggcctgcctaggcagcccaggagatgaacagtgcctgttgacagcttgcttcctgtgtcggcctgaatgcatgggttctgctcagatctactggctccttgctttcttgggagagtgaattactgcctcatggtctcagtttcctcatccgtaaaatgggaatggtggcagggcgtggtggctcaagcctgtaatcccagcactttgggaggctgagactggtggatcaattgaggtcaggagtttgagaccagcctggccaacatggtctctactaacctgtctctactaaaaatacaaaaattagtcaggcatggcgatggggcatgcctgtaatcccagctactggggaggctgaggcatgagaatctcttgaacccgggaggcagaggttgcagtgagccgagatcataccactgcactccagtctgggcaacagagtgagactctgtctcaaaaaaaaggtggttggggtgggggaatagtgctaacagtccccatctcctatggtggccatgaggaatctgtaagatcacagaagcagagcacgcagcaaggcctccctggcccgggagtgctcagagctgggatcccagtgcaggacgaggaggaggaggatgggtgccctggctacaggtcctcttgcactagattgaaaacggggccagagaagcagagcttgagagacgctgggagagggaaagtgaaactgatggtccggtgggtgaaaggtagtgaaagcccgaagtgcagtaaaccagggatcaacatctccagccaaaaggctcaccctgtggtctcagcgccacctgggcgtcagacagatgtctggagagacggctcttttattctgaaacacccctccaacttttttttttttttggtaattgtttgttttgctttccatttaatataaggagttttctcctttacaaaagttctttttgttctaaatcaggctgtaaacagaggtgctaccacaaggaccggaagcagagaccacactggtgctcagctgggttgcaggctctgcctggtttcattgtcggggaagccaccaggcctgcccccagccagcgagatgtcacgcatgcagccgggtgtcatccccaaaactcccgggaaactctcggggcaccagggcaggaagaggctgacgtcaactttaactccggggacttcaaacgaaacttttagaaatgattcctttgccctttacttggtgacgtaataaactgatctttctctgaaaagatgggccgatttgcttcaaggagctcatttcatgaggagaaaatacacacaaatatatatatatatatatatatattttttttctttttttttttgagacggagtttccctctgtcacccaggctggagtgcagtggctcaatctcggctcactgcaacctcagcctccaggttcaggggattctcctgcctcagcctccctgagtagctgggattacaggcatgtgccaccacacctggctaacttttgtatttttagtagagacggggtttcaccatgttggtcagctgttctcgaactcctgacctcaggtgatctgcccgcctcagcctcccaaagtgctgggattacagacgtgagccatcatgcccagctatatatatatatatatatatatatagaattttttaaggaaacattgctgctttgctacaaagtatataataatgtaaactggactaatacgattccttcctcctttccttggagaagtcacagacttttaggattggagaacggttcacatgcatgtgtgtggggcagttggtcagagctgtccattatgaaaggtgcttctagaatacttggggaatgtgggagctagaaaacaggttgttattaaaggaattgaaatactcccacttgaaatgttcccattttctctgtaaaggaatttcttgagcaaaggaaaactctacatcctctgtctacctgaagttcaaaattagtggtgtttggttttaataattttagtagttgatgacaaaacaacgctctctgctgtcctctctgtcacatctaacatgatgtgaatgaggcagtccctgatgtgagatgtgctgggttttgcaggggtaatgaacatcgatctgtgtgttccatcgactccttctttaaacttgtatctcagcacttagcctgtgtcataattgtctgtgcagaggtcaaggatgggctcttattcatctctgtgtctcaaaccctgtgcctgacacatagcagttcctcaatgaacatttgctgaatgaatgaatgaacaaaggaatgaacaaaccaatagccggaagtcctaccacacaagaggttgtctccaatctccctgactttccctcttcctcctgtaccctcaacccatcagctgcctgtactgctgtagcaacaacttctctctgaaaaccttcccaggggagaaaacgcgccccccctcacgcctcagaggcacacacctatcctagcctttgtttttttattgctgagagtacagaaagcagcggcttctgaaggaggtatctattttggtcccaaacagaaaagagtgggtgattctgtgggcagaggtggcaattcctgaatgtggtatggtgactcacgcccggaggtgctcagaatttcctctgttttgtggctgctggggcaggtgcgacactgccgctttctctaaagatgcccccaagctgctctgggggtagaaggaaggctgcagggaacagcaggacccggagaacccagaccccaaggaccaggtggtccttaagccatcctgcaggaggccggctgctctagcaggttgaggagtgccacgcggctctgtgggtaccgcctcactgcatgtacctggggctgaaggagcagtgggcattactcacagcctattacttcacctttgtaaaaaacaaaaataacttccctgctcacatggcacctttgtctttgacctttagcagcagtttagacaggaggaaaaaaggcaggttctggaatgagagcgcctgcttcctatcctagccccttcctcgttgggctacatcaggcaacccatttaatctctgtaagcccatttaaccacagttcaccaggcagaaaatggggataatcatatgacctactttattttgagaattaaccaaagtaatactatgtctgaacataatacctgaaagatagcatttaggcaatggatattcactgtggtggttctagctagtgttcaaatgttttctggaacaaagcttgaagcaaataagaacgaaaggaaacataactatcagtatcggagttggtgcatgggccggctttaaccagtcatgtttcctagtctatagctttgctcattttcttaccaaaggaaatcagggcctgttggagactgtcctattttccacgctctttagaataaagaaaccaatggctttcacaaacttccttatttaaaattaattatcattttaaaaaatagaggtggggtctcactatgttgcccaggctggtctcaaactcctgggctccagggatcctcccctcttggccccccaaagtgctgggattacaggaatgagccactgcacctggctgcagcttcctttttattcttttgaaacattgctctttcttcttcttttgggtaaaaggactcaattgctgctagtccaattgcaccagcttgttcttgcactgcatacagcgtgggaggaaaaagcctgggaaacggggggacatgggccagcgagctcatccggccacaccttccaccatggggcaggcccctctactggcacaggatgtcaatactcctgatccgtatcttgccttccctccacccgttcctcttcctcccagcacagtgaccttccggtcaaccccacccatgccacccacactttgttgccctggagtttcctgccacctgaacccctccttaagcaggatgcctggatccgggtcgagggctgcaggcggagctgctggtcaaaaaccccccggggaactggttgggtgtgggagtgggagaatgggctgtcaggacaaaagcactgggactccagccctgtggtgtgcacgtggctcgggctgggtcaggaaaaaaatgtggaggtagggaaacaagacccaggaactctttggctgccatccagggtcatgtggtgctggtgataagtgatcagtgacccattgaaccgaggacgtctaccggggaccaatgacacctgtagacactgcagggttgaagctgggggagaagcactcacatgctgtctgtctgagcaaaagtattcgtttttgtccgagaatctgagactcatttgcttggcacacacacacaaaacttcatgtatgttgaaatatggctcattatgtagttgtcctggcaaacccctcatctctctaattggtcagctcactactcatggaacacggtccatgtacacgactccagcagcatcactagaaaacaccattctccagcccctctcctgatattcagaaccaccattcagagccaggaggtcccagggccaccttctctgagaattttttttctagttctccaggtagcatgttactctccctattctgatcatttatggcattatttgcaatgtttgatcaatatttgatctttcccagattggttttccctttttctaatttttttttaagaggcagagtctcactatgttgcccaggctggttttgaactcctgggctcatgggatcctcctgccttggcctcccaaagtgcaggtattacaggcatgagctatcacactcagcctattttctcatttcagtcgcaagttctgtgtgggtaaaagcaatgcgtatttattctctgacttgatagccttgttactcaaaatggggttcatgcacccacaacataggcctcctgtggaacctgtttgcaccagaatcttaggcggtaacccctgacctcccgagtcagaatttgctccgtgacaagatccctggatgatttctaaatgcattaaaggttgagaagtactgcttgagcatacctgttcctagtgaatcagaccaaccatggaaatcattattccatctctctaatttggtgagtttcaatcctaagtgcgatttggaagtattcaaggaactggaagggaaggtattgtgatgttcggttctgttccccagagagtccgcttaattcatcttatgagtcttggccatcactttttttttttttttttttttttttttttttttttcaccgcccttaatccatttaatcctgagtggacacagcacatgtttcagagagcacagggttgggggtaaggtcacagatcaacaggatcccaaggcagaggaatttttcttagtgcagaacaaaatgaaaagtctcccatgtctacctctctctacacagacacggcaaccatccgatttctcaatcttttccccacctttcccgcctttccattccacaaagccgccattgtcatcctggcccgctctcaatgagctgttgggcacacctcccagacggggtggtggccgggcagaggggctcctcacttcccagtaggggcggccgggcagaggcgccccccacctcccggacggggcggctggccgggcgggggggccgactccccccacctccctcccggacggggcggctggccgggcagaggggctcctcacttcccagtaggggttggccatcactttttaaagcatcctggatatacactaatgtacagctggcgttttgaaccattactctccacacatttcccagtgggaactgtgttttctttttgacagaagcaaaccacggagtcgccttgagatcagtcaaaacactgagtaatcttagagtggagaatacctaaaatttctagagacaattatattattgttttcccctaaatgagtgagttacttgagaatatggtggggtattcagtgggggctattggcaaacactgttggctgacttcagaatgggagccattcagcagcagtttcatctcccgtgttaaactgtgagcacaagaggataagagctggaactttcttcatctctgtaatcctcatgcatgaatggatggatgaaggaatatcactgagaattcatgtaaagatgtgcagatgtgcagggaatattgaactgaaatttaagagggctggattcaagttcagcttctatgtgaactctttcagtgaagaaggtcttataacttttagaagtaatcaactgaattaagattctcttttcagctgggcacagtggctcatgcctgtaatcccagcactttggaaggcccatgcagatggatggcttgaggctcggagttcaagaccagcctacgcaacatagcaaaaaccccctctctactaaaattacaaaaaaggagccaggcatggtggtgcacacctgtaatcccagctactcaggagacagaggcaggagaatcacttgaacccaggagctgaaggttgcagtgagttgagattgcaccactgtgctctagcctgggcgacagagcgaaactgtccaaaaaaaaaaaagattcccctttctcttctctcagggaatggcctgggatagagaagagaaacaggttcccactcatgtaaaacttctcccatgggagacaaggacattgtttgaggggaaaattcctacacaagcaaacaaacagcagaggaccccgccctccctgtccagggcaggagcacagtggaccacctgctgcccctgtgtcttggggcctctctccctggaatgtcactgatggaaatttaccagtccctcagggctccctttccatgtcaccctcatgaagctttctctgatagccccatgctcagtagatcttaccacatatgacttgtgttaccatgactatatctatgcctttctcctcctcaccaacttatgactctcttaaggatcaggactatgtcgctcatttttacatttcctatagtattgaaaaggggcatgagagatattggatagattttgagaattgagtgagtggagtttttgcgttgacacctgcaactgcagcaattacagaagcagtgggtcatgctggctgccaggcagtacttcttcagagctggaaataacccacaatgagacatcaggcttgggtgcattgatacacaaaagtcgctcaaccctgaccgtgccagtatgtcttcatttgggaaactttttcatcccaaagttccccagcttgaaaatgccttttaagcagagcttattttatttcctttctggaatccttgacatagagtgaaggaactggaagggagtttcaagatccctgggtgacctcctcattttacagagagaaatctgtcaaaaactcacgccctccccgtgtcctctcctcagtgctttggcccactttctgcttcctgcaaggtttattttcctgctaattctattccctgtgacctcaagcaacatgcctcatttcctgagggaattctctctttttctgtaaagtttctgctcatccttgggcaagaagaggagcagggaagggtgggaacagctgccacgttgagggactgcctgccttgatgatatccatagctcgcagaagaatgactccaacaaaaaagtcacaaagaggactgggtgcggtggctcatgcctgtaatcccagtgctttgggaggccaaggtgggcagatcacctgaggtcaggagttcgagaccagcctggccaacttggtgaaaccccgtctctactaaaaatacaaaaattagccaggcgtggtggcaggtgcctgtaatcccagctacttggggaggctgaggcaggagaatcacttgaacccgggaggcagaggttgcagtgagccaatatctcgccactgcactccagcctgagtgacagagtgagaccctgtctcaaaaaggaagagaaaaaaaaatcacaaagaggtattcagaatacccaaggctttaggcaaaaaccagtctgggaatacttctctatcaggggagtggggtggagtagtggagttttagagctcagcaaccgttctatattagcacctctaactgacgcattcgtgaaactcattcttttggtgcagaattgtgaagtcaatttttttctttttcaattctcacatctaaaatgaagtatatgcacaggtgatttatcaaactgcctatttaaggcatgctgttttaaggaaagtagcaactgtcttatgaagagctcccaatgtttaggaaagcccttacagcctcaagacatgtcttgaagatgaatgaagtaacagtagcaataatactttgggatctcaagaagttgaaagattaaatgtgaagggttaaacattttgtgtttgactgacaaaggtgaagatgggaaattccattgtgggcagttgtctttacaagaatggataattacacaaacacattatctcaatgggtttccacactgtttttttaaagaattatttttgagtctagaggataaagatttgatcacagaattcctagaatgaaagaaagatgatcaagggacatacaagctctcagaatttccacagttctgagaaaggtgccttcaataacgtgccatattggtaataccaggagaattctctttctgaccacatcccagagcccagtaatatagagactaaaaacactcaagttgactaatatgtcctcataaacccttgccatgttaaatggtggctttggaaattttcagaatgaaaatctgcccttatgaatcagctagaaattgcatctgttgacagtctgatttcattagagaactcttaccctgaggaataaaaagtctgatttgtttcaagactaggttcctcttggagaaaaagtctgtgatgagatggtttcttaccctggagtgatgcctagaaattcctgttgattccagaaacttgacccctgtcattgtctttggccactgggtcctcatttgccttgtgattggactattttaagagcctcatgacctgtctctgtgcacctgatctctctccactctatgccagtatcatctccataaagcgctgaccctgtttgcaatgaacagaaacagaacaatccagggagaccaggttcaaaccctggcactctcactgcctgtgcgagtctgagttttgggttcttgcttcatctaggggttcatgatatccatactgcaaagtggctatgaagattacaataggacacatatctggcacatagaagttactttataaatggtagttttaaattttcttgtagttctttattgcctactaggtgaagttaagaagttatcactaggagaattctctttctgaccacatcccagggcccagcaatatacagactaaaaatgcctaatgccttagatgattcattttacctcatcctaactttccagtttgaattccccatatccccaccctccctgtccagggcaggagcacattggaccacctgctgctccctaaggcactcctgtgttttggctcattggggtctctctccctggaatctcattgatggaaatttactggtcccttggggctccctttacatgtcatcctcatgaagccttctctgatagcccaacgctccgtagatcttaccacactctgactggtattactatatttatatctatgtttttctcctcctcaccaggttataagttgcttaagtgtcaggactatatctccctcatttttgtatttcctatagtgttgaggggcagatggggtatggatagatgttgagaatggcgtgaaggagtccttatgggactctagttcccctgctccctccaagaccactcagacccttggataagtcaccaatagctagaaataacacgagtttacttgaaatgtgtcttccagaggcagagcatgattaattgtcaagattttcctgttcttggcttagactgagttagcaaagaccctgtggatgtagaaatcacattgaaaaaccttcctaaaagtatgccctctttataagaacggcacgatggactctgaggactcaggggaaagggtgcgaggtgggtgagggaaaagagactacgcactgggtacagcatacatgctcaggtgatgggtgcaccaaaatcttacaacgcattgggtacagcatacatgctcaggtgatgggtgcaccaaaatcttacaaatcaccactaaagaacttattcatgtaaccaaacaccacctgtcctccaaaacctattaaaataaaacacataggtcaggcgcgatggctcacacctgtaatcccagcactttgggaggccatggctggtggaccacaaggtcaggagtttgagaccagcctgaccaatatggtgaaaccccatctctactaaaaatacaaaaattagctggtcgtggtggtgcacgcacctgtaaacctagctactcaggagtctgaggcacgagaattacttgagcccatgaggtggaggttgcagtggactgagatcacgccactgcactccagcctgggcaacagagtgagactctgtctcaaaaagtaaaaaaaaaataaataaaaatgtaataagtaaataaaatgccctctttaaagacactcctacatctgggccagtacacagcccagcatgactgggcacttcccctaaacaagcaagcagactcctgaaatgcatcattatgtttcatttcttaataaattctttctacagccagttagcattctacttgttgccattatagactttcaaaaaacactataaactttcttatctgtcttcctgagtaagcaaagggaagacattattagaaaattcacactcaattaggaagagtggtttgaggtagaagttggtggttttttatttctttaaaaaaaaatattggccaggcacggtggttcatgcctgtagtaccagcagtatgggaggccagggtgagtggatcacttgagcccaggagttcaagaccagcttgggcaacatggcaaaaaccccatctctacaaaaaaataaattaaccaggtgtggtggcgtatgcctgtagtcccagctactcaggaggctgaggtgggaggatcgctaagcctgggaggcgaaggttgcagtaagccaatatcgcgccactgcactccagtctggctgacagagacagtgtcaaaaaaaaaaaatcttcgagaaaatccatttgaaacaaggaatgaaatttaaaatttgcatatataaacacgtatacatatacatatcatgtatatacataggattatgagaagtagtaatgttctaaaagtgagtatgcatatttttaaaaatttctgtaaagttgcacttgtaaggaaattcctaggtgttatttcctaagacgtaaaagcagtgtatacatccttgaagctaaacttttctgagatcttaaattctcccagtgtttgatatatgagtactcatgtctccagcaaattaacctgaacttaaagagcttcctgatagcttcttagttggggggtgggagtgcagagaataaaaggaaattcattgaagaataaaagataatttcttgagaaacctgctcatcgggaccctgttaacatccaaatatcccaaatatcatgccacactattcttcccagaattaattgtcaaggactgagaaggacaggagaacctaatgctatttcaggctctcttgacagaccaaggaacagtgaggcataaactggggtccccgtgggtcacaggcaagaggtggaacccaagattcaactcccttcttggaaccatctacctggggactccctctggttctgtggctgggaagagggatgcccatcagccttcccggaattccgggggcacccacaggcccttacctgcctggcagccaggcaccatgatgaacgtgagcagtccccacatcagcaggtatgaatccatcttcctgacccttgggaccagccggggcagtgaagcggaggtctttctctgcagaaggcccagttgccgtcagcctctttttggcatcgcgccggaggatgtgggatgggaagatcggtccgcctgggctgtcacccttgtgggtccatccagtctctatcggagtcaggagttgctctctttaagtattgggctggcgtgttcagccaggaaactgcc

SEQ ID NO: 1800 - DNA, 4228 bp, Homo sapiens
  source 1..4228: mol_type = genomic DNA
tttttgatgattatcaacagaaactttatttctcatcggttcaggaacaatcggagggtagatggaaagaggaagggagggaaagagggagggaggaagaatcctgcgaaaaggaagggccagactgagggagaagaaaaacatgttcggggcaaaagggtaattctcaagtggggaatgccaaatgaaggggtgcttacatgggggcacaaaattccaaatcagccacagtggggtgaggtgagtatgagacgcaggtgggttgaatgaaggaaagttagtaccacttagggctacaggaccctggggttcttctgtcagaggattggggttcaggtttcaggctttagggtgtaacatgggggggcccagtaggggctatgctggttgcatggggaggccccaggcccctccccaagggcccctccttttgggggaatctcactgacgaggcagagtcgttcactgtagtctggctgcagactctcagccagtcccttagacacaccactccaggcctaaagacagatatgtccaggtcaggggtcaattaggggcaggaagtaaaagaccgagctctgtgccaaaggagtactcatgatgtctgcaaccactgtaattgattacagaagggatacacaggctcctgggcccccaataccagttgccatctgcctcattcaatctataatctgcacttctgtgtgtgtctctctctgtatagtccatgccccatttggtcggccacatcctgacagttagtgcagggcctccttccctctcctctctgcccccacccccacactctgtctgtcttgctggcaggcagttggcagttgatagactgcagcatgcttatgacagcgttctcaccgaaaagttcccgtggtattcagtaacaagatcctctaggttcttcagggtgggaattcggggcatcgtcctgacaggggagaaagagggagcaggagcacataggttaaagcttttttatcacccttctcccagttgtcccatatgaaataaagtgattctgtgttctctgtgcctgtggcttccttccatcaccaaaccctcttgggtaatctctcattacttactgtctcatcctttactcctaaagaccctgcaaaaccctcctctgctattgtcagctaccgttcccctcatttttctgggcttctccaaatctcaccgttccagccagaaatacacacagagaaggctgataatcaatcccatggagccaacagagataaccacggcttccaatgcaaacaggaaaggattctctatagaaaaaagaaaagcaaagtggaccttatatttgttgtgcccctactacatgccaggcactggtgccaggcaccgcgctaaagacatactctctgtttaatcctcacaacagctcctgtgaggcaggaacaattacctccatcttacatcttaggaaacagaatccaagagtttagggatgtggccaaggccaaagaggtagtatgtggcacagcctagatccagctggttccaaagccatcttcaccttgcaggctctctaggaatgcttcagggaaatcctatacattctatagcccccttgagtacccctcagcctccttctcaatccactcccctactctaacaacacgctaacccaaccctacacagaaaaaccttgatttctagaggttggggttagacagtgtggagagatggggcaccaagtttaggggctttagtgacagggaagtggagcaaaagacagtggtgttagaaaggctggggtgttgggctcatggattgggtcatgtgggcccattttaccttttgaagtattgctcccccagtggattgggtggctccattcactccaatgctgagcacttccacagagtgggttaaagcggctccgaacacgaaacgtgtagcgtttctgcccatccacactaggcaaggagaacttatgtctataatccactgattgttccttgaggagaaagaggatgagggaaagtgggtgtctatgagagaagggagaattaaaacatactcctgaacacccaccagtgtcatctctgctactgcccagtttctctctcatctcttgactactcaagccacactgctcccttcactgacttgaatctaatgcctcccctctggatccccttaatggcttccttttgtttacttgtctatctggtatcaggaagagtatgggtagggaatccctaatgaaaactcactggtgtcaggaatggtggctcacgcctgtaatcccagcactttgggaggccgaggtgggcagatcacctgaggtcaggagttcaagaccagcctgaccaacatggcaaaaccctgtctttactaaaaatacaaaaattagccaggcatggttgtgcatgctcccagctacttgggaggctgaagcaggagaatcacttgaaccagggagacagaggtcgcagtgagcccaagatcgccccactgcactcaagcctgggcaacagagtgaggctctgtctcaaaaaaaaaaaaaaaagaaagaaagaaagaaaagaaaagaaaaaaagaaaactcactggagaaaataggggggaaaggagttggaggagggagggtagggggtgagcagagaagctgggaggcagagaacaggagcttgatattaggtccttctatctgtctggttgaatcctttagccctactttcttggccttagctgctacattcacgtccctagtcactcacagtccagctgtggtcccagtcagtccggtactgcaccaagtgctccaaacagtggttcaagaatctgttgttccagttcagttctagctgggattcactcagtttgtgaagtgttaggttctctggagcccaggggatcactggagatatgtgtgcatatgtggtcattcccctggcctagacaagtcaggatcctgaaggtagtgcccctaatacctcctcccttcccatcatgatcccctacctcctcttttctgcccatgtacccttatgataaaagaacactactctgtagactccaatgtcccacagtatccctggtctcttgaccctttctttccaaattacccagattctgcagttttagcatctgtgtggcctgtctcctgggttcccgtgggtcctggagctgaacaacaaatgtttggtagaggtggatctcctttttttgcaactgacagccagaagtgatttcttcagagaatagatagtggctgcacttctggactttatcattatccgagttcttgtacctagaggagaaaggttggaaggaagaggaacagtggggccaatctgggtactgcagatatccagagcctagcctcatctcccctcaaccgacttatgacttaccccaggagaaaacagtggggtacctgggagacttgctaccctctctcttggtctctgatccaacccacctcttcttcatcccctccccctcgtcccttctcataccaataatgcagagtgaggttggtaggctggggctcagagctgctgttccaagtgcaattcatgtactcgacattgaacacaaaacactgaacctctgggaggggcagagtggaaacactgagggagtcagtgggcatagtggtcaggaagaaatctagattggggagaaaatgaaggcagggagggaaagagaaatgatggtcagaaggaggaggccaagcacggtggctcatgtctgtaatcctggtgctttgaaaggctgaggcaggaggatcactagaggccaggagtttgagaccagcctaggcaacatagtgagaccctgcctcaaaagaaagaaagaaacaaacaaacaagaaagaaagaagaagtagcgtgaggcagggaaccctcccccttgcccttcccactccacttttcaattctgcccacatgattgtaatggccagtggcaggcaccagatctctgtacggccccttcccacagccacccttctcaccagccccctccagtcccagatttcccaccagctgtggtgtcttcattcccattgggcgtcagaattgtcgtgttcagccccactcccagcaggggcagctgcaggaataagagggatgtgaatggtaatgatggcttcaacatggcgcttgctcttcattccctgggtgtagtctgtctgtgtcaggaacctgggtccctcacccactacccctccccacccacacgtttcctct

SEQ ID NO: 1801 - DNA, 50870 bp, Homo sapiens
  source 1..50870: mol_type = genomic DNA
gggtctccgcgcccaggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggatgacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaaggtcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccatttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtgtttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcgggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcagctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggtttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacggtgttgtccccggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatgtggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccctggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacacttggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacatttttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctcatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccactgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagcgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgcactaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgccttggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcagggaggtcatttcctgccacccatgtttccccaccctgaatccaccttcctcacattcccattggagggacaatctctggacatatgggacctggggtcccacagggctgcaatccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggatcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctctttttttttttttttttttccgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctgtagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacaaacaagcccacaatttccatggcttaacactatgggaatatatttcttgctcacgtaacaagctaacgtgaatgttgctggtttgtaggtggtttccctccctgtagaaatctggggagtgaggttctttccatcttgtggtgccgtcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcgcataaatactgtaatttcaaagtagataagcataaataatactttatgatactgaaattgtgatgtgatatgagaatagctgtgagttttgttttgctggggacaggatcagtgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtaaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgcatttactgagcagctactacacaccttgagagtagagctgagaacatatcgacaaggaccccacttttttctttttttttttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtgcaggccagagatcttctggggtgctttttgcaagggggaccaggataaggctctccaaggagggaaaatttgaggggggccctgactggggagaatgagctggccagggataagcaagatggagtcatcccacatccccttacaacgctgggtgcctgggcaactgggggcatctgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaatttaattttattttttgggacagagtggagtctcaaaaaccaagctggagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccaccatgcctggcctcatataagcatttctgtctccatttatcatccatctttccctcttgaaggtcagtttcaccaaggcaggcatctttgtctcgttcactgttgtggcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagagacagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaacgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcttcctgggttcaagcaattttcttgcctcagcctcccaagtagctgggattacaggcatgtgccaccacgccaggctaattttgtatttttaatagagatggggtttcttcatgtcggtcaggctggtctggaactcctaatatcaggtgatccacccacttcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaagctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 1802 - DNA, 50870 bp, Homo sapiens; identical to SEQ ID NO: 1801
  source 1..50870: mol_type = genomic DNA

SEQ ID NO: 1803 - DNA, 50870 bp, Homo sapiens; identical to SEQ ID NO: 1801
  source 1..50870: mol_type = genomic DNA

SEQ ID NO: 1804 - DNA, 50870 bp, Homo sapiens; identical to SEQ ID NO: 1801
  source 1..50870: mol_type = genomic DNA

SEQ ID NO: 1805 - DNA, 72752 bp, Homo sapiens
  source 1..72752: mol_type = genomic DNA
ttaatacatagctcatttattttatcaaaggagaaatgtattccaaagtaagcaatttgtaatgctgtatgaaaatattttatatacagatatagtgtcaaaattaaatacagatatttcattaattaaaaggtaaacatatattattatcttaaaaatatatctcccaaattgcaaacttatttagacaagttataatctatataaatgacaatgtaactcagtactaaggtttagcatccttagactaggtgaatttatttttattttattttatttttttgaaattgtccttttttcatgtcaaaacatttgctataccatttattgaaggcactgtgttacacattcatgattaattaaatctcttgaaatctcttttaggtatcttggaccttgttatgctgttgcttacttaaggtttatgactctcttattctcaccggcattatccatatatcattgttaactctaaaacatctccagcacagaagaagacaattttcactcttaatacagtataatagattcatagtgagccataaaattattttgacagtaaagcaatgtcaattttgaatctttgaaaccattatatacttcatagatttaatgtcttgaaatatttaaacaggtttgagaagtattattgcaactgataccttacatggattgtcttacaaaaatcagtacagaattatactgattgataaatgttcacatatataagaaatagtttgttgactggagcattcagtttccattgtttgtattcatcttctagtaatacaatatgcatttctcaaatgccctaatccgttttgaccatggtgcattcagtaacttctaggaagcattccactctgaaaaactgcataagcagatagattcttggaggatgcagctaaagttcgtgtttctatattgccactccatatttttcagtgttctttagtgcccatcaaaattttattccaacaagtttttatctcttgtaatagtctctttaggaaacacaagtcattcagttttttctgttcctttaaagatttattttcttcctagagaatagagttttaaaagtttaaacttcacatttttacaaaaatatatattttaaaatactatttttcatcatattactttatactgaaaaactggtgcaatgaaaaggtagaatcctgtgtgacattttaaagacgatgatttctaactatctttgtgataactgacatgtagaaaattcaaggttggtgtgattaaagacttaggattctccaaagagctatatcagctgaccgccattttcacagtttaacagtggacataataacactgtttggaatttcatgagaaaggtaattgtaggttactcagttgagtttctttaatgtagaaaaatgtatttttagtgggaagaataatcaacattgaaaatactcagattattttgccaaagataataaggatatagctgatggaacttgtaccctaaggtctcctccaacaactaaccttcaccagagtatgtcagatgcctgcctcataagctaggttttagcacctgacaagaatcttaaaaagggctacctgtacaacctgtaggaagaaagagatacttggcatgaacagacatataaaggagtaactctgtatagactcagttatatttctctgagtcctctgacctgtgagaatgggaatagtgcagggtagagtaattcttcacttagataacaactagttgatcacaaatataaagcataccagtgacttttaccccttcctagaccaggaggtgatatcagttgtttgttttacactcttcacagttgagcccagacttcagggttaaaatcaacatagtgttttcaacaatcactagcaagtaaatggatgtgcaagcaatataaaaactattataactagttattgggtaactagataatttagataacaagttattgggtattctctcagtcatatattgtgctcagtgtttaacataatttacttcattttatttgcttaatcatcatatgaacttgatgatttgaactcatttcacagatgaagaaactgatccgcaaagaagataaataagctgctaaggtcaagtaaataaatatatgtcaagtaaatataatgactgaatcttgagctcctctgtcctatttttaatttggccacaaattcagatctctttttgtcatgtatttagtaacactagcacatactttttaaagaatacatttcaaagattaaacaacagatctcaaagggaaatataaaggcaaacttttcatattgttttcaatagggggtcctggacaatttttttaagtacaagttgaagttgatttgcctaagcagatttgaaatatacagatgtgaaaatttcatacttttccttgcacaccgagaataagcattcactaaaaagtaaaaaacagagaatcttggttttacccctgcatcctgggaaaatagttatcttttcttttcttttttttttttttttgtttttttttttttgctctgttttttgttttttgttttgagacggagtcccactctgttgcccaggctagagtgtagtggcgcgatctcggctcactgcaacctccacctcctgggttcaagtgattctcctgcctcagcctcctgagtagctgggactacaggcgtgcaccacgcccagctaatttttgtatttttagtagagacggggtttcaccatgttggccaggatggtcttgatctttccaccttgtgatccgcccacctcggacccccaaagtgctgggattacaggcgtgagccaccgcacccaacctttcttttctaaactttccaaattctcttagtgaaaagccttcagggtgattatattgcttttagcttctgtattcacttcagatgttccactttgcatagaatccctagaatttcctaaatctcagagtgtacaggctcactttgcttttctgaaaagagtaaggaatttccatgttgccatgtagctattggtcaaataatggaaatataaaagaagaatccatcacttttatgaaccaggtgtgctcatttttccatgcctcaacttaattagtacctatatcattttaaagtttagtcagatccatttaagtattctgccttattaagtcattcataaatattttccatattattgtataatttatctaataatgtctagtagtatatgtataaatatatgtttatatactattatatattatttatactgtacaatctacactaataaaagaggtatatataagataagtccttattgtttaatttttatttctttacaaactaacagggatggctttttttcttcatgtatttgtcatctagtttattttctcctatataaattatttgttcatttcttttacgtgctagctgcaatattttaatgctgcttcttctaaaaaaaaaaaaaatcatgcttttgtatttgccctaacagcttctattttaaaatagtgggtttaaaaatgcaatttaaaggaatcaaatttttgaggggcacctcgcttctccttttatcaatgttataataaattatttcaaaaccagctataagaaggaaacaattcaaaatgaaaaattaggaattaagttgagtaaaaacctgatgaaccataaggaaaattatacaattattctcaccaaactctttgttggttgggcttcacccagggcagctggttttcttcctttaaccttaaaaacaaagtcacatttataatattgaatatttcttcattgctcctccagttgtttgtaattgctaattttcatattgccttcagctcatctaatctatttgagactctactttaaatttcttattgttaagaaagtaaaatattaatatgatttagaaatggaatatcagggtaaaggaagaagcaagatagttcagtcttctgaatacccagaatccataattttgtaggtctgcctagtactgtgttaactactgtgaggtatgaaaaattaacatagtagggtatagtagcagagataaaacttgaattttaatcaatataaaaataaagttaacaagaaattgttaaatcctggccatacattttattaagcttcacttatcagaaacaaaatgaaataaaacaatagtaaaaagcttgtagcgtgcctggctcatgaagaaaattcagtgtagctgactgctttaacatcttgccttgttatttcaagaaaaaggtgacttgtatcaagttaatcaatgtaatataatttaatttcaaagatttaaattatttgcatattttctttctctacagttaattttggaacatgatgatccatataaagctcaatacataagagaaagaatcacaaatatataacatacctaagacctttacctcttagtagaccaagaggtgatatcagttttccgttttacactcttttcagttgaaccaagagtggaggcttataatcaacacagtattttcaacagtcacaactaattaattggatgtgcaagcaacataaaacctatctgcattagacagtactttgaaaccgctgttaagtaggaatgaagaaatggtagactagagtaggaagtcttcatgaatcttgagccgagccttgaaggcatagaacaaaatagatccaatttatagaaaaaaaaagtagaaatgctctctaggggacaaacgtaaggacgcaagtttggaaataagtttggcaaatccagcacactaagaggagacttgcttccatcaagtacataaagcaatgataaatgaggctatccaagttatataatagataatctacatttttatcactgtcaataggattcaaagataatcttaccattttaccttctatgggaaactactagtgctcaaacaaaacaaaattcttttttaagtcataaaaatgttatttaagaaaatatttaaaaccataaaataaacttttggttttgtgtggcagctggtaaaatccaaaaagaggtaaataatacaaataaaataaagcactgtattaaatattgaaaactttttagtactaagcactttacatgtgttatgccatttaatcctttcaaatcccacaatgtagatatgtttttctgcattttgtagataaggaaactgctgtctagtctctagatgatgtcttccatatttggttttgttgttttagttcataaccactagtagaaaagtaggaaaatattagccctatttgtatcaaaattatttaaagaagggaaaattgttggacatgtttatgtctagtttaagcctataaagatatttgttaaatacatttgatttcctgttttattgactaggagttcttgtaaatgtgtacatatatggattaaagctattaataagttttagatatagaaatttaccattccccacccaatatatcaccctagtatccttggaagttattatggcaatgaagaatttatttatttattttttactcccctttcacaaacaattcactctagccaagagataaataggtatttccaaactgagcctttcctcttctaggattgagtaaacatacttcaactttagatgataataaacacttaggattctatgataatggatgtgatcatcagagaatagtggtatcttggcacaggagtatttaatatttttattcaaagtaaatagtccttagcttacctggccagtgcagttcaacagtattgttgtgccttctgaaacttttaataagtggagatcaaaatcaccagtgctattcattttaagaaattgcctcaacttgcgagcagcacggaataaaaacataccttcctattataggaaaaagtcagaagggccatggttcaaataaaatattaagaaattataagctttcttaaggagcctagagcttgagctatgttgctaggtaatgccccgcctccaccccagctttctattccagttaatcatgtgattgacaagtaacagaactaaaactgtttggctcctaggtgacagcatgaagttcttagaacttggtttaataattatcttgacttttaaagtttgttttctctattatgcttatgtgatcttatcgcttatgtgtgaacatattagaagattattcaattttaaacatgataaccgaaggagaagacttctggaagcaacaatgtattataagaggtatgtgtggttttttcttagtatttcttgcatcttttgagctatggaagaatagctgataataagaaaataaaggactgtagtcacctaaaacataagttttgcagatatttaaattaagaaatttaaaaaaaagaatttatggttgtgagatgccatgaggctaacttagctactgtgagtttttaaaagactatgaaatagcacacttgtttctgtagggagaaatgatataaactttttaggttttttaaagtgtaatattataccaactagatgtggtaatcatttagagataagcaaatattgaaagaaaaattttcaagacgcttccaactaaattataccaatgacttatatttgtatgtgtgcaagcattcacattaacaagtatttttctgtataagaaatttagaggccaggcaccgtggctcacgcctgtaatcccagcactttgggaggcggaggcaggcggatcatgaggtcaggagatcgagatcatcctggccagcatggtgaaaccccgtctccactaaaaatacaaaaattagttgggtgtggtggtgcatgcctgtagacccagttactcgggagactgaggcaggagaatcgcttgaaaccaggaggcggagtttgcagtgagctgagattgcgccactacactccagcctggtgacagagcgaaactctgcctccaaaaaaaaaaacaaagaaagaaagaaagaaagaaaataagagataggtgtgtctttgaattcgacaattctagtattttcaaggtaaaaaatagaatggtgaaacaaaaaaaacttgttatttaataagcacaggactatttgtaaaacaaaaatataaaattgggccatagtatgatttaatcaatgggaattatgtgatcaggctgcaaatattaatagtattcatataattgtctaacagaggcacaaaaaatagaagcttctataaaatcaagcttgaatgacaaactccaaataattatcattaccttattagcatcacagatatgtcttttaaaaaagttaaattcattattcaggcaattgctaccaatttctttcatgctgtcctgtaataaataacataaaataatatggttaaaactgagtacttttctaatatcttgtaattataaaaaataataatcttataatatctgatatttatatgtgcattttaaggaaaataagttttgcctggctcagctgactaagcatgaggaatcattttctatagttgaaggataaataagtgtatacacaaatcctcccatatttagagcccctcccagatcccataattgaatcccagaattctctaagagaatctggctcatctagggaaatagaagtacctattttagaagttatgctttatagacaaagtattataaaatgtgaagtcattaagttgagatgaacttaagaggttattcagtcaaatttcctgccatcaacaaataacaagaaaaggaatttatattagaatgaagggatccatacaaagctcaacacataagagaaagaatcacaaatgtataacatacctaaaccctttaccccttcatatcagttgtctgttttacactcttttcagttgagctgagactacaggcttataatcaacatagtattttcaacagtcacaactaattaattggatgtgcaaggaatataaaaccatctgcattagtactttgaaattgacagtgagaattaaggttgaaatttgttcacaacatttttagcaatccaattttctgggatggttgaggtagaattttcctgagacagtgtaattatatgtgtgtattataaacataggagtgagaaagcagactgatatgtgcgctattttttttttcatttacaaggaatgtagtagaagaaggtagagattatctaaatcaataatttagttgatattaggaaaaacctcctaaggtttcagattttcttatgcaccgggttggactagctctgtccagcaaactagcaactccatgctatcagagcttctgggactgaaagcaatcttagcctatgtaatgtctccagagaaacaggataagaagtggagcaatggcaggatttagtcatgggctttgaatcctcatctgcctctcagaaaagtattcattactcttatcacctgtgaaaagcatgatgatgtctgggtttaccctgattttaaaatgtatatactatcagctttatctgcaagaagtgtctgaatacatacatctcaagtgtaaaagatacattttcaataactatcttcacattgccattgtacatattcctgaaaatttagtggataattaatatttgcctattaagtcattttcatgttgacttccccataccccaaggacaataactcatacataattttttctttgataaaacatagagtatttaatttttaccatgtcatccttcaaaaaagaaggtgaaacgtgtagctactctatatgttatcttccaattcaccaaaaatatcgtatgagacaatatgtcacataatgaatgccaatttcttgcaacatgttagcaaattgcatgacacatgaatatttaaaaagccatattggttaggtggctgttctaggttattaataaaacttatttttggcagatccacagaaagataatgttataccagttgattattttttacctaatgcttgatatggaatgtaaatgtgttactatacccttaaaaggttgactcctatagaggtcacagttattaattcatcgaccttagtacattttattaatgcatctaatatagatctatatgattgccaattactgttgctttctaaaattcttttcattcatgccctatcagaagaatggctcagagtaagaattatagatacatggtgttgaaaagaaacttagatggccatcttttgatttaacaaagaatagaattacttgaccaaagtcccaataattgtttcttattcacatgtcacatatgtccagatgcaaataagaaacaaatcacagctaggcatggtgccttatgcctgtaatcccagccctttgggaggccaaagtgggtagatcgtgaggtcagtagttcgagaccagcctggccaacatggtgaaaccccatctctactaaaaatacaaaaaaaaaaaaaaaaattagccgggtgtggtggcacatgcctgtaatctcagctgcttgggaggctgaggcaggagaatcgcttgaacctgggaggcggagcttgcagtgagctgagatcacgccactgcactccagcctgggcaacagagcaagactctgtctcagaaaaaaataaaaaataaaaagaaacaaatcatatatcacatatgtcaagatgtacataagaaacaaatttcttcaaatattttataaatatggaaaatcagaagagaaaagccaggattataagactgaactgcagtattttctagtataaaacatgacattggctaagttcttttttttaggtgaagttattttttaatacttttgtcttttaactcttatagtagaggaaaagtaacttataaactataattacagtatacacttaattacatacaaattcattacagccctctgaatttgactatattttatctttatggtgaattttatgctttatctttacagtgagttatatgctttcatatcttttcatgtttttagtgtctttttctttctctattttttaaacatttattttaagtccaggggtacaagtgcaggtttgttacataggtaaacttgtgtcatgggttttttttgtatagattatttcatcacccaggtattaagcctagtatccattaattgttttttgatcctctccctcttcctaccctccatcctccaaaaagccccagtgtgtattgttcccctgtatgtgtccatgtgttctgatcatttagctgccacttataagtgagaacatgtggtatttggttttctgttcctgcattagtttgctaaggataatggcctccagctccatccatgtccctgcaaaggacatgatctcattgatctcattcttttttgtggctgcatagtgttccatggtgtatacgtaccacattttctttatccagtccattattgatggccatttagtttgattccatgtctttgccattgtgaatagtgctgcaatgaacatacatgtgcatgtgtctttataacagaatgatttatattcccttggttatatgcccagtaatgggactgctgggttgaatagtatatctgtctttaggtctttgagaaattgccataccatcttccacaatggctgaactgatttacattcccaccaacagtgtataagcattcctttttcttcacaaccttgccagcatgttattttttgactttttaattatagccattctgactggtgtgatatggtattccatatttctcggaggttttgttcattccttttcattcttttttctctacatttgtctgcctgccatatttcattaagctctgaaattctttcctctgtttggtctattctactattaatacttgtgattgcattacgaaattcttgtagtgtgtttttcagccctatcaggaggattaagtacttctctatactggctattttgaacccttgctggagaggtaatgaggtcagctggaggaaagagggcactcaggctttttgaggtttcagcattcttgctctgattctttctcatttctgtgagcttatctaatctaccttcaatgttcgacgttgcctacctttttttttccccctggcacaatttggccaattttccatagggctgctgtggtttgctgggggtctactccagtccctagttgccttggattttccggtagctgaaggtatcaccagtgaaggctgcaaaacagcaaagatggcagcctgccacttcttctaagagctctggcccagggaggtatgaacctgttgccaggtggaacgcacctgcaggaggtggctggagatcctggttgggaggtcttgcccagtcaggaggaagaggattggggacccacttatagaagcagtctggccatgcttttgtagagcagctgcgcagtgctggggtaacgcttcaccgcctgttggcttgggctctccaaagcccacaggctggacaggttcagtacccaaatagcagagatgtcagcccacccctccctctgagacctctgtcccagggagttttcaaatctctgtaggccagagaacaccagcggggatggctggaggccctggttgggaggtcctgcccaataaggagggatggctcagggacctgcttaaagaagcagtctggccacgtgttggtagagcaattgtgctgtgttgggggatcccttctgcccgatcggtttggactcttcaaagtctgcaggctgaaaaaggtgacttgcccaaacagtgaagatggtggccttcccctctccctgggaactctgtcccaggtaggcacaacactgctgctggtggctggctggaattccaagccaatgtgtcttatcctttgaggcaccatggaagtagggcctacagaccatcgctgcttggcccactggattcagcctctttcctaagggtatgcacaaggatctaatctcctgcttttctggagttgcagttacttttgccgggaagcctgaaggtggaatatctacagttcctggttctccaacatgtgcctgagcagcttctctgccaagactcccgtatctctgtgtattagactgaaagccctgatggagtgggttcaagaggggatctcccaactcgaggttgcaaagattcgtgggaagagtgtggtttccagggtcacacattcactcaccgattctctgggcaggggaggttcacctggctgggtgtcgtgcccaggtgggctgtcgtcctgcctttgttttctatgttctccatgggtcaagttgtttccttgattagtcccagtgcgagtacttggatgtttcagtggaaggtgctgtatttactcgcccttttgtccctctttgtgagagccactcacacgagctgcttctagttggccatcttggccacttccccactccttttctttcaagttcttaaaatacataatgttctttacatttgtagaattatatcttctttaatttcagcatagttttcttctatctttgaatttttaaattacattttaagtatcttctttagaaacactaattacataaaaaatgaatcttctattgaactttttcttttcgtgtatgtgtgtacacacgtatatatacacaaacacacaatttcgttttgtgtggtttttacccatcctgtctttcatatgcctgttttaatggagtattcatttctggtttttattttagtctctgtatttctccaaaatccaaagaacatttgtttctttctggtttctttcatactatattgtttttagctctttttacattggtttcttagagacttcacattttccattgctttcatggataattaaactttggtctagatacttcattttccttttgcctattttgtgttaattcatttgttcatttattttgctagtaccagtgcataattttccttttaaattttgtgattatttttgaaaagatgctaaagtagagtagattattgttcagccagtatttaacatctaaactcaacaaatgagaggatgttttcattccatatggctgatgtaacaaattaccaaaaatttggaggctcaaaacaataaaaacttattatctcacatttctagaggctctgggagagcatgcattgtttgcctcttctatcttctggtgtctgccagcattccttagtgttccttggcttgtggcctagtggctccagtctctgcctccatcttcacatcaccttctttgtgtgggtgtcaagtcttctcctgcttttctcttagaaggaacttgtgatagcatttagggcccaccaagataatccaaaataaacttatcacaccaacattcttaattcaatcacatctgtagattcctttaccttatacattttcagattagaatttttttatctgggtggccattatttagcctactatagagaagtatgctcctctgtccattaatgttgagtttgtccaaaagacatgtggtaagaaattgatgctttcagtacagtttctgtggatcaagaatttggaagctgcctaaccgggagcttctagttcatctttcatgaggaggcagtcaagatgttggtcatgtctgtagtcatctggactccatcaggattagaggatctattcccaagatgacctattcatgcaggtattggcagaatgcctcaatttctcaccacatgagtttctccacaggctttcttcaatatccttccaagatagttgctgactttcccccaagtatcaatgtaagagaaagcaaggaggaagccatgtcttttattacatggaagtcacacactgccatttcctcattattcagttgcttgcagtgagtcactaattctaatccacactcaagaggagggaatttaagctgtacctcttgtaaggtggagtatctttgtgcatatgttaaaactcccatacagctgctccttccatcttatgacttagaatgaaacacatggaggtaatcgaactcagccaaactgcatacctgtgaacctaaggtaaatgcatattactgtatgcctttctctctttctgtgtgtgtatgtgtttgtagcaaaaactgactgatagagaactattgctttttagatcaactaattgtccaaaaataaaggtggaaaagggcaaaggtaatgaaatgaaacagctgttcattcttacccaatttctgtattctttgtgataggacagttttcttctgaatttttttcatatttttcttttcaggagagaaagtcaatatggttcacagttactcttcatggtcacatgtgctagagctagcaaacgaatgtctaattattgctcatagctgattgctgcttcctttctgttcttttttctttctttttgtagggctgattctaaggattggaaagttttggcatagaatatattcagtctcatgtctcttgctataaataaagttggtccctatagaaatatacttcattgctttttttttttttttttttttgagatggggtctgttgcccaggctggagtgcagtggcatggtctcggctcactgcaacctctgcctcctgggttcaagcaattctcctgcctcagcttcctaagtaactggattccaggcatgcaccaccaaagccagctaatgtttatatttttagtagacactgggtttcaccatgttggccaggctgtcctcaaactccttacctcaagtaaagtagaaatatttttcatttctgatcatcactatgacaacctatccatggccttgtgccatctgaagccttatttagggggccttttaaaatgcgctgcttattttttagaaaatctactctgtatgaaatttgaaaaaggtgtatattgttcctggaattctatctcaattgctacaatttttaccatttgtcaggtagcttagcagattatagtatgacttattagttaattcttagtttaaattaaagtcatttattctttgatcaaatatttgagcatttaccatgtgccatttagtattaggaatacaacagggatcaaaatcatacgtggctccttccctcaagaagtttattatttggtggcaaaaacattaatccaataacagcaatcaattcccaacttgagaactgttatgaatacaagatatatgctgccatgaagcctatacaagaagattttacttaaaaacctcaatgaatacttcccggagaaggatacttcacaagagatctcaatcataagtaccttagggaaaagggggattcagtagcaaatagtataggtgactactttgaagagagagggatcatggcctgtatgtggctagaaagaagagagcaagggaaagtaggaatatggctgagagaggaagagacagaactggtttgacataaagccagagctggaagagaccaaattatgtgtggccttaaggatattttaagaagttttgtatcaatcctaaaagcaataattaatgtatttgtacttacaaacatgggaacagtttttctagtttacttttttcaatggtcatattaacagccatatgccagatggtttggagagattcaagaaagtatatgggtgaatctttatgaggctattacatagtcagtgcttaacataattatttattgcacttgatagtaagagagaatctagaaatacatgaatagatttgagaaataagcaaatttaatgtgatttgaaaataaaaattaagcaagatggacatatcaaggatcattcttgagttgtctggtgagtacaacaaaagagtcagatgctccttaacttacaatgggtttacattccaataagcccattgtaaattcaaaaattataagcctaactatggtaagctggttaccatcagtattgtgttgccattgagataggaaatagaagaagaggtggagtgtataaattatgtgttaggttttaaacagatgacgtttgagctgactttcaaagattcaggaacagatgtcaaatagacaaatagtaaagccagagagttagaaggaaagccaagagaatggattgttttgaggaagtggtggtccatagtaaatgccaattaaaaggtcaagtaaattgagtcttgttcaaaatttatctacataaagaaaacagctaaaatagaaaagaaagctaataatggaatggtaaaatagatgatggaaaataaaataaaatattaagcagatatatttgttttcaggtaatgttcataaacaagtggtaaatctataataaaacattaagagaaaaaggtactatgtagaagcctatatttaaatgtgaatgcatatgtagacacttgaacacacttatctaccagaagtttaactgtcatttaactgactttctggatgatcaatagtttctattccttctgtcaaaacatattcactaatgcccagagaacaatgaagactccaaactagtagtttagtttcttatgtactcgtgtatattttctcccaccatttcagttgcttattgactaagtcaattccttaacactaagttatacttagcatttaattataatacttaatactatataaatcaataaaatattagtataaaatagttgttttgagaacttctacttttccatttggcatataagaagcttagaagttgccaatccatacttaaaagtaaaaagctaaacccattaaaaaaaaatcaacaactcttcttagatcagagaagtgaggtcacagggcaaaccactgccctaaagttggagagaaagagaggatccccaaattagagaaacagatagaaccacaacttactgaagcagagatccatgagcagaaacctccatagcaaccattgtgggggtagaaaaaattaaactgtaattggcaaattgctgaaggctcagtgtgaaacaacttagagaattaaaaactccaagggtacccagtcatagttgtgggggctatatacttttatgagtttgatctttaggagctctaactactaggtcctcacagtaagtatcagatgagaaagtcctcttgtgcttctggtaggaggaggggaaaaaactattataaaataagccagaggtgggaggatcacttgagcccagaagtttgagaccagcctggacaacatagtgagatcctatctttacaaacaattacaaaaaaattagccatgcatggtggcacatgctggtggtcccagctactcaggttgaaataggagcatcacttgaacccaggaggtcaaggctgcagtgagccatgatttatatcactgcactccagcctgggtgacagtaagaccctgtctcaaaaaaaaaatactaatttctaaaaagctgaatagtctgttctcctttaaagggcctaaactcaagggtgactattttaccagagcctaaccttctgaggttttatcagagtctgatctgcctggggaaaaaaatacccagctcaagggtcctctagtttttcacatgttggaaggctgccctgtaccacctaaggaggggaaaaaaaagagcagcactgaaagttcacagtccaggtcacaggctcgccaaaagactaagacctaatcacaggcttatagaacacatcccctttttccacaccgtattgtgacatcactaaaggcctgtttatcacagtttcttttactcagaacattataatcagctatgaaaaaaaaaattacaaggcatactagaaggcaaaacacacagtttgaagagccagagcaagcataaggactagacttacctatggccatgaggttggaattatcagaacagaaatctttttaaaagtctatgattgaggccaggcgtggtggctcacgcctgtaatcccagcactttgagaggccaaggcaggcagatcacgaggtcaggagatcgagaccatcctggctaacacggtgaaaccccgtctctactaaaaataccaaaaaattagctggacatggtggcgggcacctgtagtcccagctactcaggaggctgaggcaggagaatggcgtgaacctgagaggtggaggtttctgtgagccgagatcgtgccactgcactccagcctgggcaacagagcgagactccgtctcaaaaaaagaaaataaataaagtctatgattaatatgctcagagctgtcagagctgtaatgaaaaaattagacaacagacaagaacagataggaaatttaagcagagagattaaaattctaggaaataattttaaaatgataaagatcaaaaacagaaagaaaatatgcctttgatgggctcattagtagacttcacatagctgaggaaagaatcttggagtctaatgataggacaacagaaacttccaaaactgagaagcaaaaattcaaaaaaaaaaaaactgataaaaaagaacagaatatctaagaactgtgggacaactacaaaaggagtagcatacatgtaatgggaatataaaaaaggagaagagacagaaaaagaaaaatcaagggatgaagaaaatatctagaaaagaatgcaaagtggagaaaagaaacaacttacttatagaagagcaaagataagaattacatccaaattcaccacagaaatcatgcaagcaaaaagagagaggaatgaaatattcaaaatgttaagagtaaaaaaccagtgtttaaattatgtactctgtgaatttagccttcaaaagtgaaggaggaataaagcctttctcagacaaacaaaaattgagagaatttgttacaagtaaacctgccttgcaagaaatcttagcagaagctattcaggaagaaggaaaattacataagttagaaacatggatctaaataaaggaaggaacaacatcagagaataagtgaaggtaaaataaatactttcccttatttttactttttttccttttatttttagttgacacaatagtcgtacatatttatggatgacacagtgatatatttccatatgtgatatacaatgtgtaatgatcaaatcagggtaattagcatatccatcccctctaacattcatcatttctttctgttatgaacaatccaaatcctctattctagctttctgagcatatacaataaattatggtaaactatgttcaccctgcagtgctgcagaatgccagggctaattcctcctatctagttataattttgcatctgttaaccaacttctccctatcgtcccctccctcctacccttttgtgcctttaatacccacaattttattctctacttccatgaactcaattatgttttagctcccacatataaatgacagcatgtggtgtttatctttctgtgactgaccgatttggcttaatataaagtcctccaggctcatctgtgttgctgtgagtgacaggatttcatactttttttatacctgaaggttatttcattgagtgtatatatactacattttcttcatccatttgtttgttgatggacacctaagttaattccatgtcttagccattgtgaatactgctgcaataaacattaagttacaggtgtccctttaatagactgatttcctttcctttggataactgcttggtagtgagattgcaggagcacatgctagttccatttttaattttgtgaggaaacttcatactgttttcaataatggctgtactaattcacattcccaccaacaattccaatggtttccttttctccacatcctcatcaacacttatcttttgtctttttgataatagccattctgacaggtgtgatagctcattgtggtattgatttgcatttttttccagtgattagtgatcttgagcattttttctcatacttattggccatttgtatgttttagtttcataaatgtctattcacatcctttgctcacttttgttttattattatacttgaagttctgggatacagaacgtgcaggcttgtaacataggtatacatgtgccatggtggtttgttgcacccgtcaacccgtcatctacattaggtatctctcttaatgctatctctccccttgtcccccaccctgcgacaggccccaatgtgtgatgttcccctccctgtgccaatatgttctcattgttcaactcccacttaggagtgagaacgtgcggtctttggttttctgttcctgtgttagtttgctgagaatgatggtttcctgcttcatccatgtccctgcaaaggacatgaactcattattttttatggctgtatagtattccatggtgtatatgtgccacgttttctttatccagtctaacattgatgggcatttgggttggttccaagtctttgctattgtgaatagctgcaataaacatatatgtgaatgtgtctttatagtagaatgatttaaaatcctctgggtatatgggattggtgggtcaaatggtatttatagttctagatccttgaggaatcaccacactgtcttccacaatggttgaactaatttacactcctacaaacagtgcaaaaacgttcctatttctccacatcctctccagcatctgttgtttcctgactttttaatgatcgccattctaactggtgtgagatgatatctctttgtggttttgatttgcatttctctaatgaccagtgatgatgaactttttttgatatgtttgttggccgcataaatttgaaaagtgtctgttcatatcctttgcccactttttgatgggtttgtttatttttttcttataaatttgtttaagttccttgtagattctggatattaggtctttgtcaggtggataaattgcaaacattttctcccattctgtaggtaacctgttcactctgattatagtttcttttgctgtgcagaagctctttagtttaaatagataccatttgtcaatttgggcctttgttgccattgcttttggtgttttagtcatgaagtcttcccatgcctatgtcgtgaatggtattgcctaggttttcttctagggtttttatggttttaggtcgtatgtttaagtctttaatccatcttgagttaatttttgttctaaggcataaggaaggggtccagtttcagttttctgcatatggctagccagttttcccagcgccatttattaaatagggaaacctttccccatttcctgtttttgtcaggtttgtcaaagatggctgtagatgtgtgatgctatttctgaggcctcggttctgttcaattggtctatatatttgttttggttccattaccatgctgttcggttacatttcctttgaaaactggtacaaaacaaggatgccctctctcaccactcctattcaacatagtattggaagttctggccagggcaatcaggcaagagaaagaaataaaggatattcaaataggaagagaggatgtgaaattatctctgtttgcagatgatgtgattgtatatttagaaaacctcatcgtctcagccccaaaactccttaagctgataagcaacttcagcaaagtctcaggatacaaaatcaatgtgcaaaaatcacaagcatccctataaaccaataatagagagccaaatcatgagaaaactccaattcacaattgctacaaagagaataaaataactaggaatacaacttacaagggatgtgaaggacctcttgaaggagaactacaaaccactgctcaaggaaataagagaggacacaagcaaatggaaaaacattccatgctcatggaaagaagaatcaatgtcgtgaaaatggccatactgcccaaagcaatttatagattcaatgctattcccaacaagctatcactgaaattcttcacagagttagaaaaagctactttaaatttcacatagaaccaaaaaagagcccgtatagccaagacaatcctaagcaaaaagaacaaagctggaggcgtcacgctacctgacttcaaactatgctacaaggctttgctcactttttaatcaggtttttgttgttgttttgttttgctgttgagctgtatgaattccttatatattctgaaaattaatcccttgttggatgaataatttgcacatattttgtctcattctataggttgtctctccactctgttaattatttccattgctgtgtagaagtttttagtttaatacagtcacatttgtttctttttgtttttgctacttgtgcttttgaaatctcagccacaatatctttccctaaaaatgttctgaagcatttctcctatattctcttctagtggttttatatttctgggtttcatgtttaagtcttttatccatttcaagttgattcttatatatggtgagagataggggtctagtttccttcttctgcctgtgaacatccagttttcctagcactatttattaaagagaccatcattttcccatgtatgttctttcatatttgccaaaaataagttggctgtaaatacattgatttatttctggcttctctattccattcccttggtctatgtgtctgtttttataccagtgctatgttgttttggttatagctttgtagtatattttgaaattatatagtatgagacctccagctttgttctttttgagcagtattgcttttgctattcaagtcctttgtatttccatacaaattttaggactgttttttctctttctgtgaaaaatgtcattggtattatgatagggattgcattaaagttgtagattgctttgtgtagtatggtcattttaacaatattaatttttccaatccataggcatattatatctttacagttgtttgtattctcttcagtctttcattagtgttttgtagttttcattgtagaggtcttcacctccttggttaaatttatttctaggtttttatttttattttattttcctggcaaaaattgtaaatcagattgctttcttgatttctccttcagctagttcattatgatataaaaaaatgctactgattctcgtatgttaattttgtatctggcaactttactgaattcatttatcagttctaagagtttcctggtggagtatttagatttttctatgtataatcatgtcatctgcaaagagggacaattgacttcttcttttctaacttggacatcttttatttctttctcttgcctaattgctctggctagggcttccagtgagatgttgaataggagtggtaaaagtgggcatccttgtcttattcagttattataagaaagactttcagtttttcctcattctgtaagatgatagctgtgggttaataatatatggcctttattgagttgcaatactttgtttctatgccaatttgttaagagttttcatcataaagagttcttgaattatatcaaatgctttttttctgtgctagttgagataatcatatggtttttgttcttcactcttttgaagtgatgtatcacatttattgatttgtgtatgttgaaccttctttgcatccttgggataaatcccactttattatgttctattattttttagatgtgttgttagattcagtttgttagtattttgttgagaaactttgcatattggcttgtagttttctttttggttgtctctttatctggtattgctatcagggtaatgctggctttgtagaatgaattaagaagaattctctccttttcgtttttttctttaagaatagcttgagaagaattggcatttgtcttgctttaaaagtttggtagaactcagaaataaagccatctggtcctgggcttttcttttttgggagaattttattattgattcagtcttgttactcgttattggtctgttcatgtttcctatttatttctggttctgtcttgacagggtagatgtatttaggaattgattcatttccgctaggttttccaatttgttagtgtatagttgctcaaaataatctctgatagtcctttatatttctgtggtatcagttgtaatgtgtgctttatttgtttctgatttacttatttgggtcttctctctttattagttagtccagctagtggtttattttttatcttttcatctccttggttaaattttttctaggattttatttttattttattttccaagtggtttatgtttatcttttcaagaaataaaattttgttttgttaatagttttattatttagtttagtttagcttttagtttctatttcctttttttctgctctttatttttgccttctttgtattaattttgggcttggatccctcttgcttttctagttccttgtggtgcactgttaggatgtttatttgaaatctttccacttttttgatgtagatggctattgctataacattccctcttagcactacttttactatattccataggtttgggtatgttgtgtttacattttcatttgtttcagattttttttcattttgatcttcattttttcattaatctaatgatcactttgaagcctattgctttatttcaatgtatttgtacagtttccaaaatttctcttattattgatctatagttttattccattgtactctgggaaggtactcaacatgattttgatttttaaaaattttttgagacttgttttgtggactagcatatggtttatcctgaagaacgttccatgtgctggtgaaaagaatgtgtattctgtagctgttggataaaatattacgtaaatacctgctaggtccacttggtctatagcacagattaagtccaatatttctttgttgattttctctctagatgatctccccagtgctgaaagtggggtgctgaaatttccaactcttactgtattggagtctatctctctctttagctctaataatatttgctttatatatcttagtgctccagtgttgagtccatatatatttacaattgttatatcctgttaatgaattgatcccttcatcattacatactagacctctttatctcttgttatgttctttgactttaagtctactttgtccgatataagtatagctactcctgcaaagttttggctttcatatgcatgggatatggtttccgtcacttcactttcagtctatttgtgtctgatatggtttggctgtgtcctcacccaaatctcatcttgaattgtagctcccataattcccatgtgttgtgggagggacccagtaggaggtaattgactcatgattgtgggtctttcccatgctgttcttgtgatagtgaataagtctcatgagatctcatggttttataaatgagaatttccttatacaagttctattgccagccctcatgtaagatatccctttgttcttcccttgttttacaccatgactgtgagaccttcccagacatgtggaactgtgagtccatttaacctctttcctttataagttacccagtctcaggtatgtctttattagcagcatgaggacagactaatatagtgtctttacccatgatgtgaatttcttgttggcagcatataattgggtcttttgtgttttcttttctacccattcagccagtctatactttataattgtagaatttaaaccatttacattcaatgttgttaataataggtgagaacttactactgtcattttgatagctgttttctgaatgttctgtatatcctttgtttctctttcctcttttaatatttatctttacagtttggtcattttctgtagtgacaagctttgatttctttcttgctttcattagtgtatctgctctacccgtgagtttaattctttcttgtgctttctaaatagtagacatcatccttttacttatagatgttgtactccctgaagcatttattgtatggttgatctagtagtgatgaatttccttcagtttttacttgtctgaaaaagatgttatttctccatcctttttaaaggatagctttcctgggcatagtattcttcattggcatttttctctcagcactttgaatatagtttctcatgctctcctggcctgcaagatttttactgagtaataggctgctagtctgatgggatttcccccaacatgtgacttgatgtttttctcttgctatttttaaaattctccctctgtcttcaacctttcacagtgtaactttaatgtgccttggagaacacttatatttttattgaatctactagtagatattttagctttctatatctagatgtctatatccttcacaagaaggaagaatttttcagatattatttcaataaataggttgtctatggcatttccattttcttattcttatggaacttataaaattcaaatatttgtttgctttatggtgtcctatatgtcattaggctttcttcattctcttttattcttttattcccccccccacctttttttttaatctggctttgttattttaaaagaccaagttcaaaaattcttctgcttgatttagtctattgttgaactcttgattgtatatatatattttaatttcatccactgaattatttatttccaggatttctgctgggttcttttttttttttagctttaaacaaaactcacattttatttagattgaaataaactatacaaaattgattttcttcaccaaaaataacagcaatattttccatatttttctagataaaccacaacacttattttgtaggttttccaggttttgcttataaatcaagatgaggcagtagataagagtcatggaaaaaagacagaaaaaaaaaaccagacaaatcagttgtcagtatccatggcctctgattctgtctcaaccatgaaacagaagtgttcaacatatacctgctaaaaagcttaggaagatgtaggctccacaaaggaatgtaaacagcaatgagatgtggaacaacagcaggcttttccattcaaactttgtcatttgtttctttaagtttgagaaagacaaaatctacactgaaatccttgtttggtgagctcacaagcttttctctggtaatttcttgcaactgtccagtatagatttttaacatacttaaaactcctattagtcaaaggtcaattgtgggcttaactataacattttataaaatgtattccttcctcccacacctcttcaaaatatattttttcaaagaattcataacacccaacaagtagagatccacagtgataataaatgctatgtctaaaatgacttaactgaaacaattccagagtgccgtcaacagagatcacgcaaaaggaaacatggaactttcaacgttctcttctggaagaacaggtaggtcttcaaagcttgagagttcaaacaggggccatttaaacaggtagattatcaatggctaatgtattcaatggagtcctataggcaaagatatttagtgattaagtggcctacatacaccttacggcttttacttccaaatatcaaatataagaaagcctgtttttaaaagtctcttaggtattttccacagtttcggaattatctgtaggaagctctgacttacttgtatagagtttaatatatgtgtccaccattaaatccaggtcgtgttttatatcaaaatttatgttaagcaaagccaagttacttgacctttggtctgtcaaagtgttcctcaaatatgctttaagacgctttcatccattttcataccgctcattctcaaccttcatcacagaagaatacacaggaccttcagcaatgcatacacattaggaaaaaacttgatgtcaggcagttggagggcttcatagatggtggacggaagctctatatctttccccctgtgtttccatttgattccccaacaatgaagctcagctgacagcgtgtcaggattgggtaagtcacttctatacatgtcagcatggtgttcctccaaagtattgaatttgagttgtcccatgactgagggtaccagagataagcatttaagagctttgaggtgctgttctgagaatatatctttaagttcctgaataatgtgctccactgttgggacacttagggtttctttatagtaactctcaaaggttagctgagattccaagttaccctggtgagctctgcggaatttcccagggagtttcatttgaatatcaagtttggttgccaaatttgtggcttcctcaaaccaaaattcattataaacttcaatattttccatcacttcgttgagtgaatgcagtactgcagtcaagctaccggctgcaaagaagacatcagaggtttgcccctggaggtttttcccaaaggctcttgtaaaagataggacatttttaagaacaacaatagtaacaatgaaatcaaaatctgttactgcactgcagagtacaaatgctcggccagctatacagttattccatctaatatttgtgtcactatttataccatctaaacataaaacaagtgcttgcaggagttccactaaaatttcaaaagcatcatgcctccctgtccactgagaatggcagatttccttcagttctttacccctttctttactgttctgaaaaagaacagaaattacgttgtcaagttctaaaagcagttgtggtgatcgatggaaaaaagaacaaacttcctcgattgttcctaatgcaacagatactcccataacaggtactgattttgccaaccacatatttaaggcacagaaagagcagagtgtgtagatagcttggggatatttctctaaaagtctagaagcaacaactttcattttggaagaaaatccactagagacaatgtaagcctggccacgacaatactccatatttaatccccacttctcagttatcatagtgtgaaatttcacagccaaaatttctgcatcagcttcataaggcaggaagcctataaattcctctcttaggttatgagattcatcaacaaacctcaccaacacaggtaggtgctcttcccctgctatgtccactacatcgtcagtgataatggaaaagacgtgtgagtctctcacttccctgagagtttcttctcgaatacagctctcacagatctctagcatctgcctctgctgtgtttttgaacaaaacaacgtgttaactgctgttgtctcaaaccgctttctcagaacctcttcaccagaatttatccgacactccagtagtgcctgaaagttatctggagtaaagagaccttctgggatttcatcagcctcatgtccgtccagaggtatgttttgccttcccatcagaatcaagatttcaagtagatatttgaggtattctttgttttccttctcttcaagggttagaggtaaaatgtcctcatcttgcccttcaccctcttcttcgctggggttctgagcattgctattgttggtttctttatgtttttgttcctgctcagaagtttcatcaatttttttctgtttcagtgtcctgatttcatcttcactcagttcttttattcgttttctgtgtctactatgtgggttgttcaaatgactgttaagatcaaatattgttggtattgcattatctcgaagaactgtcctataaggaccagttctacagatcatagaggtctcaaaatgtttggcacataatcgataatgtttatttagctgatcaggtgttttatcttctaagtctgctctcctacagttctccacccacttctggcatctggcagggtcccgcgggaagctgaagaaggccaagtcaagtcggactgcgtgctcttccgcgtgcagttggcggcagcgcagaagttcggcatcgtcgcccgcccgccggccggtccagccctcccctccccgcctcctcagggcagtccgcccgcccgtcggggccggggaggggagccaggccggccggccggctcggcagggccgacgcgcgggggaggggcgggcgggctagaagccgccgggttcttttttatatctgtctctctttcttgaaattctcattgaagacatgaattgccttcccaatgcatttttttttttctattgtgtcctcttgtatttgtatctgtgtcctcttgtatctcgctgcattttcttaagaacattattttgaattctttttcaggctttttaacatatttacatttctttgggatattttactgaagaagtattgtattccttcagaggtgtcatttttttcttgaattttcatatttctcatgtccttaccttatctgtgcatctattttaacagtttctcttttaatttcatggattggcttctttcatagagaaagacttttcctgtagctgtaattatagtattgtttggggaagatgttttggctttaattctgggctagcacagtagtgtcgtctctgtatgttctatttggatgcgatcaatgtcagcattgtctgagagttcttcattggcttaggctctggttgttagtgaaaattatggtgaggtgcacctgtcctcatgccaccagatgctgcacacaagcactgtcagtggtgagtagaattggccaatatgcagccccctggacagcatttgttggtgccagtgatggcacatggggtggttaatcttcacgcccccagcctgtttttcttattcttaattgatataaaagttaataccttcaaataatgatagcaaccatgtattcaattatgcttatatgtttatttataagtgaaatgaatgatagcagtgataaaaggttaggagggagaaattagtaatattttattaccataaattacttgtacctcctataaagtggtataatgttatttggaagtagatttagattggtattaagtgaaaattgttcatataaaaatgatacagagacatcactttagatccaatagacattaaacagataataaacaaatattatgagcaactctaaatccacaaatttgataacctatatgaaatgcatcaattactcaaaaggcacaatctaccaaaactcacacaaaaagaaatagaaactctgaataggactatatctattcaagaaaataaataaaaaatgatgttacaaaacaaaaaatactaatcccagatgagtttattgctgaattctatcaaatagttaaggacaatattgtatcaatgctccacactatctgacagtgtgtgtaagcaggagcaggaggaatacttctcaactcattctataaggccagcattaccctaatatcaaaaatcaaagacactgcaagaaaataaaactatagacaagtacctctcatgaacatagattcaaaaatcctccacataaaactgtatacttttatacattattggattcaatttgctattggggatagcacttatcatctacaccacaattgagtggatttaatttcaggtatgcaaaggtgttttaacattggaatattgtttaatctaatccatcacatcaataggccaatgaagaaaaatcacacaatcatatcaatagatgcagaaaaagcatttgacaacattcaacacccattcatgataaaaaattttaacacattaggaatagagagggacttcctcaacttaaaggacatctacaaaagtcctatagctaatatcatacttaataataagaaatttgtaggtttcctgataataaaaaaaaagctatctcccttcacttcagctttcaacatcttactgcaaaacttagctattgcagtaagacaaaaaaggaaataaaatgtatacagattggtaagaacaaaataatacagtctttgtttgcagatgatataattgtctatgtagaaaatttttttaaattggtaaaaaagtctctgataactaataagcaattatataaaagttgcaggatacaagagaaataagtcaatcacttttctatgtaccatcaatgaacaagtgaaatttgaaattaaaaacccattgccactttatgttagcagccctaaaaataaaatgcttaagtgtaaatctaaaaaaaaatgtccaaaatacatatgaggaaaactacaaaactctgataaataatatcaaaaaaagaaaaaaataaatggagagatattccaggtcatgggtagaaagactcaatattgtcatgatgtcagttctttccaaatgaatggacagactcaatgcaattccaatcagaatcccaggaagttattttgtagaaattgacaaattggttctaaagtttatgtgaagaggaaaaagacccaggagagtaaattcaatattgaaagaaaagagcaaagttagaggactgacaccactcaatttcaaaacctaccataaacttacagtaatcaagacactatagcattagtgaaaaaacagacaaatagatcaatggaccagaatatgagctgagaaatcgactcacctaagtataatccattgatttttgacaaacgggcaaaggcaataaaatggagcagtctcttttcaacaaatggtgctaagacaactggacattcacatccacacccctaacattaatctagacacagaccttgaacctttcacaaaaattagctcaaaatggatcatagacttcaatgtaaaatgcaagattataaaaatcttagagaatgacataggagaaattcttgatgaacttgggcattgagatgacattttaaataaaataccaaaggcatgatctatgaaagaggtgattgataagctgagctccattaaaattcagaacttctgctttgcaaaaagcagcatcaggagaatgagattacaagccacagactggaaaaaatatttacaaaagacatatctggtaaaataatattatccaaaatattatacagaactcttaaaaatctaaaataagacaatttacaacccaataaaaaattggcaaaaaacctgaataagcacctcagcaaagaagatacacagatagcaaataagcatatgaaacgttattcaacagcatatgccatcagggaaatgcaaattaaaacaacaatgagataccatgacaccctattagaatggccaaaacccaaaacactgaccacagtaaatgctggcaaggatgtaaagcaaaaagaattctcattcattgctgatgggaaggtaaacagtacagccactttgaaagacagtttggtggtcttctacaaaactaaacaatctcttacgacataatgcagcaatccttgctatatacccaaagaatttgaaaatttgtggccacacaaaacccccatgtgaataattatagcagctttattcataatgaccaaaacttggaaggaatgaatatgtccttcagtaggtgaatgaataagtaaactgtggtgcttccagacaatggaatattttttcagttctaaaatgaaatgagctataaagcaacaagaaaacatggaaggatcttaaatgcatattattaagtgaaagaagccaaactgaaaaaggctatatacagtttgagtgcaactatgtaacattctggaaaaggtaaaactagagacagtaaaaagattcgtggtttgtcaagatttaagagggagcaagtggatgaataggagaggcacaaagaatgaacagtgaagttgttaggagagtgaaactattctgtaatataatttggattgaagacatttgacaaaacccatagtatgtacaacaccaagagtgaatcttaatctaaactatagactttgggtgacaatgatgtgtagagtcattgatcataataaatgtaccactgtgatagcaactgttgatagtggggaaatttgtctgtgggcacaaggagtatatgagacctctatactttcagctcagcatcctatgcctatgcgtgttaggtctgcaggcatagaaaatacacatatatacatgcatatatagggttttatgagggtattttcctttttcattttgttaaaaaataggatcacagtgtatacattacactttgatttttgtatcattctcactttatatcatgactgtcattctaggtcaaacatactagaacaattgttttataactgcgtaatattccacattaagtgtgttccacaaattattcaatacttattgatgaatagtcaaatatttgctcctaccaacaattctgtaacagacatctttgtatgtgtatctgtatgtgtttgttatctcattttatattaatgcttgcatttctgtagacttagttcccaaaagtgagatttgctgaataaaatggtatatgtatttttaaaataatttgtgcttctaccagcatataaaggaggccattctgttacattcttatttggatcagatgtcatcagtctttaccatttttaccaatcctgagaagtaaaaaattatgcctcattatagcttacatttgcatttttgtaactacttgaagatgaacatcatttcatgttaattaacaatttgcatcttcttttctatgaatagtctgttcttatccactttcttataagttttttgtcttttaatgatcagttgataattttatataagggattaaaaaaatttttgatattttactttaggtttatctcttatatagtgcatacagtgtgagtgagtgtgtgtgtgtgtctgtgtttatctcttatatagtgcatacagtgtgaacaagtgagtgtgtgtgtgtgagtgtgaacaatcaggttaattttggagtttaacataatttatatttattgtcagatagtcattctatttctttttgttccttttcctttattttataattttggtataattttggtatttaagtgactacattgtattttcctttttctttgtaatttgaaagactataattcttttaagagtgttttccaataattattaaaattatattctctaccaatctaattagtatacatatccactaatcattctaatgaaagggagggatttatcatctttttagctttctcagtcctcccataaccacgcactttttatattcttagggcttaggtgaaacaagttatttttgtgttttaatatttacaatagctatctagaaatcaccaaatactgcagcatttaatagtgattgttttatatcaccatttctctattattgatatttattaatatcttgttcaaatggagtaatcttttttattttattattattatactttaagttttagggtacatgtgcacaatgtgcaggttagttacataagtatacatgtgccatgctggtgtgctgcacccattaactcatcatttagcatttggtatatctcctaaagctatccctccccctccccccacctcacaacagtccccagagtgtgatgttccccttcctgtgtccctgtgttctcattgttcaattcccacctatgagtgagaatatgcggtgtttggctttttgttcttgtgatagtttactgagaatgatgatttccaatttcatccacgtccctacaaaggacatgaactcatccttttgtatggctgcatagtattccatggtgtatatgtgccacattttcttaatccagtctatcattgacggacatttgggttggttccaagtctttgctattgtgaatagtgccacaataaacatacgtgtgcatgtgtctttatagcagcatgatttatagttctttgggtatatacccagtaatgggatggctgggtaaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatgggggtgtttgtttttttcttgtaaatttgtttgagttcattgtagattctggatattagccctttgtcagatgagtaggttgcgaaaattttctcccattttgtatgttgcctgttcactctgatggtagtttcttttgctgtgcagaagctctttagtttaattagatcccatttgtcactggcaaaccgaatccagcagcacgtcaagaagcttatccaccttgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaaccttcatgctaaaaactctcaataacttaggtattgatgggacgtatctcaaaatcataagagctatctatgacaaacccacagccaatatcatactgaatgggcaaaaactggaagcattccctttgaaaactggcacaagacagggatgccctctctcaccactcctattcaacacagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaacttacaagggacgtgaaggacctcttcaaggagaactacaaatcactgctcaatgaaataaaagaggatacaaacaaatggaagaacaatccatgctcatgggtaggaagaatcaatatcatgaaaatggccatactgcccaaggtaatttatagattcaatgccatccccatcaagctaccaatgactttcttcacagaattggaaaaaactacttttaagttcatatggaaccaaaaaagagcccacatcgccaagtcaaacctaagccaaaagaacaaagctggaggcatcacactacctgacttcaaactatactacaaggctacagtaaccaaaacaacatgatactggtaccaaaacagagatatagaccaatggaacagaacagaggcctcagaaataatgccacacatctacaacaatctgatctttgacaaacctgagaaaaacaagcaatggggaaaggattccctatttaataaatggtgctgggaaaactggctagccatatgtagaaagctgaaactggatcccttccttacacctgatacaaaaaataattcaagatggattaaagacttaaatgttaggcctaaaaccataaaaaccctagaagaaaacctaggctttaccattcaggacataggcatgggcaagagcttcatgtctaaaacaccaaaagcagtggcaacaaaagccaaatggactaatcttaaggtcaggtttttattgaataaagaagcagtacccttgctggcctatctgtgtctttattattcttggtacattcaataaaatttgcctgggtctaagactgtgaacccacagtaacaaaacttagtagttatcacaaaattcagtagagcttggtcaattggagctaaacattggtaaaaaaatagaggctaacctaattgtatccttttgtcgacatgtttcccctctcttactggaaggatgcttccttgaaaaaattcaccttgatatatcctagtgtttgtctcttacccttgagtcataatcaacaagtttaagattttaatacagaaatatatctctcttttattctgaacttttgcttctgttttgatgggctattttctcttcagaaacacttattatttatagattagctctctgctctgtctatggtatcaatcatcttctcttaattatatatacatatgcatacacagaccaatatgcaaagacacgcacacacacacacatacacacgcacacgcacacaagtgagataggtaggaagatagtatgtagacagatacacaaattatttccttttgctttataggagatctttacagttttgtctatccagtgattatataataaaatcactcttctttttttatacacacattattataatttaagcctttaagttcctatctgatggagataaactcctctgaaagcaccatgtaatttctgaaaattcccataatgttatctaatgtgtgttctgtaataaactcttcaggttcttctccttggtctccacaacttgctgtcatagaaatgacgaacttcatgaaatcaccactttcctaggtaaagctacttctctagtgggaatcactaatgttcccactccatttgtggagaggggacagatcttattatgtcagaaagtgttttcctagctgtttcctggctgttggagctccaaaacctcccaacgcaatagacattgtggttttcattgcatatcattcctatttctctctctccattatttagcagtaatttttttaatgaaagttaataccacttccagctctggcttgagttttgattggtctaagacttagatactaagtaaataaaggttatcccatctctctgaccaaagcaacttgctcaattaaacaaggtctaaggcagttaagacctgggtcttccgctgacataaggattttttcatagataatccaatcagagtacatctaagaacttagttaattataggcaaaggaattatcattctgctggatatggaagaataaagaaaccctggtggctactggtaagccacaacatgaagattaatgccacatggagaaacgcagagtcaaaaaattgcaaagaaattaagttgaaattctaagccacagttgaaagcattcaactggggtcttttcagttatacaggccattaaataactctttaatgtttaagtccatttatgttcagttttctactaattatacatgaaagcatactgacacaaatacttacacatgctgaggaagcacacattcttcagcctggaggattcaaaaactaataccctgtgccaggccgctctaaaaactgcccccctttctgttgcagccactgctacaaatgaaaggcttgctcctgctgtaccttcacatagttaggggaatacaatcataacattggaacagctttagtcctctcttaactgagatttttaaagtaagtcatttctagccccaaagaggagaggaagtgccttcttctcctgtgggaaaacaatcagttatatttcctattccaggaaactttcttcctagaataatggacagtgcaagcaatatctaacaactgtcactatcattacactccacaatcccaaagaaaccagattcacaaaaacactaagtggaaaaactaatgattggcagggctagcatgcaaatactggtttgcctggttacaaagcccatgctttttctattacccgaatttgtcatataagtaatgtgagcttgattcaaaattttcaatcaacagaatttaatagaagagttgacaatataagtgctagcaaaattcaagacaacatattattttctgaatcctaagccctgaccacatgacatagcctgtaatacattttgtttgcttagtcatttacatgtctactttaaaaaaaatattgaatgtatatgcatattcagattttatgcataaaatatagaatgataccttccttaatagtgttcaagataaagtgcaacagtaagactacttttgacttgcgttatgaataaagtagaacctgaacttgaccttaaatggcacagtaagtcctcatctaacatcacggataggttcttggaaactgcgactttaagtaaactgttgtacaaagaaaccaattttaccgtaggttaattgatataaaaaagagttaagatcctgtggcatatttctcatcacaaaaacatcgccaaatttctaaatgaagaccccaaacatttctaatattaaacactgaattaaatatgagctacacatacatttaagaaagattaacaaaaacaagataattacccatgtttttgtaaatcagtgagtgtcgatggtcatagtggtggtggattaagtcaagaaataagtgtttgcaaagctaaaactgtcaggagcacttccaccacacagttaaaaaagaatcacaaacaagtaaggctgactcacagctggatgagcaccttcgtcttgcatcatttattgttgtgtatttgtataatgaccatttacttaacaaatttttatttgacaataatttacattgattgatttgttcattttccaaactgcttattctagttcagggtcactttccaaactgcttattctagttcaggtggctggagtctatctcagcagctcagattacaaagcacggaccagtcctggataggacaccctcgatcacagggtgcattcacacacacctacactcagactaggaccatgtcgacatacccattcacccagtgggcacgtctttgggatgtgggaggaaaccaaagtacccagagaaaacccacacagacacggggagaatgtgctaactctacacagacagtggtccagggccagaaatggacttttttctcatcaatgtcataacgaacggtattgaacaaaggatgttattcaattcctgctgtctttaaatttgggtgcgggaagatttgtggagcaagacaggggaagtagaaaattccacaatgagaaaacagcaaaggcactgaggtacaaaaatgtggagcatattttggaaacagtaagtaatccaatttggttgtggtgctgggcgtgtaaggggcaatacagagtggcaagtaggctagaaatgtaaagaacagattttccttctccaatgcccacataaggaattagtcctgcaatagccagtgagtggtaacctaaggaaagttgttgagcagcgatatggcatgatctgagccttggtttgtggcgattagtacatgtttgggaagttctcataatgtatttctgactgagatgcttatccactttgactggagaagccaattaggtagagggtagatgtgaattatgggagaaacacagtgtgaggaggaacaaaggcagaaaaatcagaaggaaggctgtctgtaggaattctgcctcattgcaaatatgcaactggggtaaatctagctgaatgaaggtactggctccaatttggccatattaggtaaacaagcattctttagtttggaacgccactgtgaaaaaaattataaagaaaaaactccaaccttattaatcatgttctacattttctaccaaaagagcagagaaaagaaaaaaaaacatatatttgtgagttcaactgtgtttaccctatctaacattttggatttcattacttataataattttcaatgcctaagttttgagaaggcaagagataccaagtatttgcaaagactaagactgcagatccttatctaaccctgtagccttgcctcttcttcatctaatgcccaacattgctaggttaacaagaaggaaaaaaagtacctggaattttttgactttagcattgattctttgtgatgacaataagtatatattaattatattctaacatgtatgaaataggacatatttaataccaaaatttaatatcccaaaagtgttttgtactaaattttatgttaataacaaaggtgaacatatactactaattaacaactgtatgttaattaataaaagctctgcatctataaaaacgtgactatattaatttcccagtccttcctatgaccaagaatagcccaagtaaagcaattctcgtgcaatttattggcactgtgcttctcatttaacttacacccataacatagcgtgttttctaatacatgtctctgtggtacataaaacaatggcagaaatagaaagttaatattttaacaattaatattgatggaatccactgtagagaacattaggacataaagaacaaacaaagaataaaaatgactatattcttaaatatggtgtttcagaataatatcatcatgaaagtgtcctcagtgcttttttatgcaaaagagttagaaaacttgtgattgtgagttttcatttgtgaaaatacctctacagaatttctctgatgaagctcaacttaagaaaaatcaattggtgaaattcactagaaaatctaataatgtaatgaatacagaacaaaagaatgtctcatgaaagggtaatgaacaaatcttagttgttaaacccattctttaacttgtgtaaagttgtgtatgcattacatttatttttctggaggtaatatatattttttattcatgagttgccttttccagctttaccaacacaccttaggtacacaacgtagtattttattaatttactttaatccaggtgtggttatataagtttggggataagaaatggtgttccaggaactatatgattcaacaattggcagatttgcctagctatcagtgttcatgttaaatacacacactgcataactattgaaaacctgacggcatattcacctgtacttggtacagtgccatacgtcacaaaattatacatatcctactctggatgtgcagaaaggttattatggaattcatccagggcattcattctttggttctcctaagtagtcgatacttctacatcagtgcaatgaaaagaacaccaaactagagtttgtggatgactgtgtgcatttctgacattgaatagttttacagcaggaatggatctcagagattatgaaaatcaaaattctaattggaaaaatcaggctttcaagcagttaactgaattgtccaacatctcatagccaaaggggcaaagtggggactctgaccaaagcatttcatttccagtcctttttcttcctgtagcgttttactgacttactgtaacctctccttgaattttctcataagcaaaatgagtacattggactagggcagtggttttcatagatcatattccatgtagtcctaggatttcataaggtaactgggggggcgcttagaagtaagcgtaaggatgatacaggatagtcagggcttgggacttcactggacctctgtgtaagattttacttcaaacacttccatgctaaataaatatttagtggttattaaatagccacttctacattctctacagtagtaccccttatccttggaggatactttccaaggccaccagtggatgcctgagaccatacatggtaccagaccctatatatgcggtacttttcttcctatgcatacataccaatgataaaactttaatttataaattaggcacagtaagagattaataacaatacctaataatgaaatagagcaattatgacaatattctagcatcactactcttgctttttggggccattatgaagtaaagtaagaatgacttgaacataagcactgagatacctctgcagccaatctgataatctaaaaggctactatgagactaatgggcaggtagcatccacagcccggttctgctagacaaagggatgattcaccccttggatgggatagagtgagacagtgcaagatttcatcatgctactcagaacggcacacaatttaaaatttacgaattatttctggaagtttccatagaagatttttgaaccttcattgatttttgggtaactgaaaccacagaagctgaaatgttggataagaggggactaaagtgaatgcaaaatcatattgtgtatgtttgaattttgctctcataaatcacacaatttctagccattttcaaatattacaggtttttatttgcatctgttcttaaggatgtgagataggaaatttagagagcattgttgcagacattatttctaacattaataatatgacaagaactatgacttgttgaatgcttaagttccaggcactgttccatgagctttacatatattagcccatttaatttatttaaaataaccctatgaagtatgggtcctaattttatccccactttagaaataaggaaactaaggcacagaaggattaagtaatttatccaatgtcacatagctagcaagtggcatattcagattcaatattgacacagggtccacacgggtcataacataagtagatgcagtataaattactccctggcagatgaaaacatctgtgatcttcatggtgaatagaaacttttcatctctataaatgacattcctactctcacattcctcaataccaatgatggtctttgaattaataacctgcataataagcaccattaagagaaaaacaactgaagcacaaatattatcattatgtgatcgacaatgtcttcatcggttgtctagttgagattcacctctatctgcacatggtaaagaagctagataataaagtttataatatctaatgcaggcatagatgtgggttcaaaacaaataaaaataccaatatagtaattttcataaaatagctattcaggcctgggagtattagacgcatcattgtcctcaaagttgaatgcacagacttaatggaagtctggccaggtatgagaacaggccttgacaacaacaggcacctataaaaaagggcaatctgaaagtgccttccttcttcactaggacggactttgtaattatgttgtggcattagcattcatctcattgctccaacttgcagtttctcctttttctctccaggtgctgggggccatttcagttttactcttccttttgggaaactacctttaaggactccatgcattcactactgccttttatttgcttgttcctaatgcaagaactatattttatcaatctttgagttttccattgtattttcatgtaataaaaattactgattgaatgacaatatcatcaatcacatactcccaaactttcagaggacatcagctgccatctgtaaattttactatggtttttaaaaagaaacatgccatactcaacagtgccaactacgaatgctgaaataacctatctttctgaatgcttttcatcacaaatttattttatatggcgcatatgaattatctttctaaatcccagatttaattctacactgctgcagtttaaaagcctgatcgctccttattatatagtcctaaagatcaagttcacattcttcggcctggtatgtaaggtcttgcaaaatctagccataccctaccttccaacttttctacatccaaatctcctctagagctacatggggccattgacttaaatctaattaccaagcccccaggtcaaattagttggtatccctaaacattttcaactgtaattatcagcattatcccattgcattgcaattctttatttaagagtctagctctctttcaaaactaaacctcatagtctggtaaactggtcttttttatacctgtgctcattatttaacagcttgcacacaatctttaacagccatttcataaatgcatgcaaaattgcatggaaaggcaggattcgaagctttgactcaaatagtcctctctgatgaaatggcattccctttcatttttgcctccttaagaactatacattcttcaaagtcccattaaaattgttattccactctgagtcactagagttcttgaagaggggaatacatcattcagatttgagttgacagattactattagcagatgcttaataaatgtttaaaataatggaatattaaggaaacatttattaaatagggaatcctttccccattgcttgtttttgtcaggtttgtcaaagatcggatggctgtagatatgtggtcttctttgtgaggtctctattcttttccattggactacgtgtctgtttttgtatgagtactgtgctattttggttgctgtagccttgtagaatgtagtttgaagttgggtagcatggtgcctccagctttgttctttttgcttaggattgtcttgacaatactggctcttttctgggtccatatgaattttatggtagttttttctaattctgggaagaatgttaatggtaatttaatgggagtagcattggatctataaattactttgggcagtatggccattttcacaatgttgattcttcctatccatgagcatgacatgttttttcatttgtttgtgtcctctctgatatacttgagcagtggtttgtatttctccctgagaggtcttcacttgcccttgttagctgtattcctaagtattttatcctctttttagcaattgtaaatgggagttcattcatgattttgctttctccttgtgtattgttggtgtataggaatgcttgtgatttttgcacattgattttgtattctgagattttgctgaagttgcttatcagcttaagaagcttttgggctgagacaatggggttttctagatataaaatcacatcatcggcaaacagtttgacttcctgtcttcctatttgcctacctttatttgtttcttttgcctgattgccctggccagaacttccaatactatgttgaacaggagtggtgagagtgggcatccttgtcttgtgctagttttctagaggaatgcttccagcttttgtccattcagtatgatattggctgtgggtttgtcataaatggctcttgttattttgaggtatgttccatcaatatctagtttattgagagtttttaacatggggggatgttgaattttatcaaaggccttttctacatctattgagataatcaagtggtttttgtctttagttcagtttatgtgatgaattacatttattgatttttgtatgttgcaccagccttacatcccagagatgaagccaacttgatcatggtggataagcttttcgatgtgctcctggatttggtttggcagtattttaccgaagatttttgtattgacgttcatcagagatgttggcctgaagttttctttttttgtagtatctctgccaggttttggtgtgagaatgatgctggcttcataaaatgagttagtgaggagtccctccttttcaattgtttggaataatttcagaaaaaatggtaccagctcctctttgtacctctggtagaattcagctctaaatctgtctggtcgcgggttttcttggttggcaggctatttattactgcctcaatttcagaacttgttattcgcctattcaaggattcaacttcttcctggttcagtcttgggagtatatatctgtccaggaatttatccatttcttctagattttctaatttatttgcatagaggtgtttatggtattctctgatggttgtttgtatttctgtggggtcagtgatgatatttatcttatcgttttattgtgtatatttgattcttctcccttttcttctttattagtctaactagcagtctgttttattaatttttttcaaaaaccagcttctggattcattaatattttgaagggttttttatgtctacatctgcttcaattcttttctgatcttggttatttcttgtcttctgctagctttgtggtttgtttgcccttggttctctagttcttttcattgtgatgttaggatgttgactagagatctttctagctttttaatgtggacatttagttttataaatttctcgcttaacactgctgtagctgcattccagagattctggcacactgcctctttgttttcattgatttcaaagaacttcctgacttgtgccttaagttcattatttaccgaggagtcattcaggatcgggttgttcaatttccatgtaattgtatgcttttgagtgagttccttaaaattgagttctaatttgattgcactgtggtctaagagactgtttgttgtgatttcagttctttggcatttgctgaggagtgttttacatccaattatgtggttgattttacagtaagtgccatgtggtgccaagaagaatgtatattctgttattttggggtggagagttctgtagatatctatcaggtccacttgatccagagctgagttcaattcctgaatatccttgttaattttctgcctcaatgatctgtctaatattgacagtgcagtgttaaattctctcactattattctgtgggagtctaagtctctttgtatgtctctaagaatatgttttatgaatctaggtgctcctgtattgggtgcatatatatttaggatgttagctcttcttgttgaattgaaccctttacaattatgtaatgcctttatcttttttgatctttattggtttaaagtctgttttgtcagaaactaggattgcaacccctgattttttctgttttccatttgctcggtagattttactattttgagcctatatgtgtctttgtacatgagatgtgtctcttaaatacagctcactagtggaccttgactctttatccagcttgccactctgtgccttttaattggggcatttaggccatttacatttaaggttaatattcctatgtgtgcagttgatcttgtcaccatgatgctagctggttattttacagacttgttgatgtagttgcttcatagtatcattggtctgtgtacttcagtgtgtttttgtagtggctggtaatcatttttcctttccatatttagtgcttccttcagtaactcttgcatggcaggcctggtgatgacaaatttcctcagcatttgcctgtctggaaaggattttatttctcctttgcttatgaagcttagtttcactggatatgaaattctggttagaaacatttttcttttaagagtgttgaatattggcccccaatctcttctggcttgtagggtttctgctgagaggtttgctgttattccgatgggctttcccttgtaggtgacctggcctttctctctggctgcccttaatatttttttccttcatttcaaccttggagaatctgatgatcatgtgtcttggagtggttcttctcatggcgtatcttactggggctctctgtacttcctgaatttgactgttgccctgtcttgctaggttgaggaagttctcctggatgatatcctaaagcatgttttccaagttagttcaattctccccatctctttcacgtaccccaatcaggcgtaggttttgtgggtttacataatcccatagttctcacaggttctgttcatttcttttcatgccttttttctctaattttgtgtcttatttcagcaagatagtcctcaagttctgaagtgctttcctccacttgatctattcagctattgatacctgtggttgcattgggaagttcttgtgttgtatttttcagctccatcaggtcatttatgtttctctctaaacattattctggttaacagcttctataatgttttatcatggttcttaacttctttgcattgggttaggacatgctcctttggctcagtgaagttcattattacccaccttctgaagcctacttctgccagtttatccatctcagcctcagcccagttctgtgccttgttggaaaggtgttgcgatcatttcaagaagaggtactctggcttttgagttgtcagtgttttttcattgactgtttctcatcttgctgaggttatctacctttgatctttgaggctgctgacctttggatggggtttctgtgggtgcctttttgttgatgctgttgttgttgttgctttctgtttgcttttcttttaacagtcaggcccctcttccataaggctcctgtcagttgctgggggttcactccagaccctatttgcctgggtctctcccacccctgggggtgtcaccagtggaggctgcgcaacagcaaagatggcttactgctccttcctctgggagctccatcccagagggttattgacttcatgttagtgggaatgtctctatataaggtatctggtgacccctgttgggggtggtctcacccagtcaggagaacaggatcaaagacccacttaatgaagcactctggctggaatcccactcgtctgaactgcctggattcctcagagccagcggggaaaagactaagtctgctgatccacagagacaacagccgctcctccccccagaagctccatcccaggggtatcagagctctgtccgtaaacccctggctggagatgatgaaattcccagagggaggccacatgcagtgaagatggatgggtccgggtgcagcctaaagaggcagtctggtgattatctgccacagctgctgtgttgcactgtggagaattcctcctggatctgaaccacccaatatctctggcaccagcaggggaaaaggcagactggagctgcagtgatggttgctgccccttttctaagttcagtcatcttaggcagcaggtagccatagcgatggtggctacccttccctctaggaactctgtagtcttaggcagaccccagcccagtggccactgagagaatatgcactgctctgtgcttggaacccaaggcccttttggtgtgggcttatgatgggaatctcctgatttgcaggttgcacccatccacggaaaaatatggtttcctgggcaggatggccaatcactcactgcctcccttggctggggatgggagtcccacttaccccctgcaggtgggccattactccactctgatttctttgctttctgtcagttgcaccaaccacctagtcagtccaaatgagagaacctggataccttagttgccagcacaggattcacttgctgtttttgttattctcggtggaggcctccaactgcaactgtgtctagtcagccatcatggcccagctctcactcattagtcttaaggttaatatgcagtaatggttatataccatcctacaagcagcgatctaattaccaattaacatatgtggcaactgtaaatttataatcacaaatgcttatatgctgtactttataactatttacttgaactttaaatatcaatttcaactatataacctgtgattaatgagacaatttgagagatgaagtatgagatggatatattcgaagattctagtgagctgaagtggggtggtaacaggcagatcaaagataaagatttattaaagaaatatgtaaagcaaagcagccaagtatgataaaccaaactgtcagaagagagtgttctgttttgagagcataactctaaacaccacctggttaagcaaaaataagcgagccattaggtaaactgcaagtaaatatatgagtagcacataaaccaatagtgagaagtcactgatagagccaatatggtgaagactataagtcatataatgattttaaaatgtcactgttatgaactgaacatttgtgtctcctcgaaattcatatgttgaaatcctaacccccaatgtgttgtcgttagaaagtgaggccttcgggaggtaattaagtcatgaaggtgaacctctaatgaatggtggtagtgccttataaagaaacaccagagagctctctagccatctgaaaatttcacattctgccacgtgaagatatgagaagctggtagtccacaacctggaagaggtccttcaccagaacccaaccatatgccaccccaatcctggacttccagcctccagaactgtgaggaataaatttctcttgtttataagccaccaaagtaccaaagtccatggttctttgatatggcagccagaagtgtctaacacagtcacttatgtatatcaacatctttacaacataattttgaattatactatatacacgatataacatataattttatgctacactgtaattttataactttaaaataacatttaagttttttttaatgtaaactatgttcattcactcagtcagtcaataaatatttatgaagggtcttgtctgtaccaggtaacattctagatggtggggatacaaggattatcaagacagagagtctctgtcctaaaaatatgataatttgagacagtagcaagaaccatgaggaaaataaaagaatataatatattttgaagaggctactctaattctacaaggaagtgaattttgtgctatcaattgaccttttactacagtgtcttcacttttctcttggttggttggattttatatccagtagctcccctccccctccatcttctccttgaaaaggctcatgagtgttctattgcctaaattctgacatacataaatttctgcctgtgcactttatatttgaacaacatcttgtctaggtatcaaattctgagccacatttttatctctcagaattttgtagacattattccattatcttttgcatttagatgtgaaaaatctgaagccactctgattctcctccaactgacttgccatttccacctttagaattattcttccttgctcttgaaattcagtcacttttccaagatataacttagtaacaatcatgttgaatcaatttttatagtacatgatatactacctagcactgttcattccattttgcctcaatttgtggaaaaaatttcctctatcataggttgttttattcttccattcgatgaattttctttggtaggaacaattattcataaaatggatcactatcatctcttcttatcttttattgtttcagcaactgtttggtatttgtatttttactgtgcatttatggtgattataacaaatctatttcatattttttgttcattcttcttgttgttgctaacacttttgtcacatctaaaatggagggagtgcataattttggatttcaatgtatttccttggttgtataatattttttcatctcattctattcttttatcaactactctttgatattctgttgtaaaattcatgtgtactttaaaactatggcgtgaagtacaaatgaaagtttttattctgtttcttcgtgtctgcccccttccagaatggatgcttatattctaggtttcttttagtctttttattttgctgtggcatttctgtatcgttgtatgttattttcatcttaaatttaaagtggaccactctgtgctgatatttatttgactccatatctcatgatcctcttctcacttatcacagtcacttctctgttgaatttctaagtgaagccacagtattatctgctctgtgtgctcttggaaagcctgggaacacagctatatgcgaaggggtatgtggcaatggtagtgcactgagaagtgggaaaacctgtggtcaattttgttggtggacagggactgtcctctttctctctttttattaaagactattttatagagcaattttaggtccacaaaaaaatgagaagaaggtatagagattcctcatgtacattgtgatactgtgaaatacagttatgtgtcacttaatgataggggatatattatgagaaatgtgtcattgtaatggtgccattagatgatttcatcatcgcacaaacatcatagaacccaaacctaaatggtatagcctattacatacctaggctataaggtatagtctattgctctcaggctacaaacctgcatagcatgcactaaatagataataataacacaatggtaagtatttgtgtgtctaaacatatctaaatatagaacaggtacagtaaaaatatggtataaaatattaaaaatagtacacttgtatagggcaccttccatgaatggagcttgcagaactgcaagttgctctggatgagtcagtgagtgagccatgagtgaatgtgaaggcctaggacattactgaacactactgtgctatacctttatatgactggcagtgcaatgggtttgtttacatcagtatcatcacaaacatgtgagtaatgcattctaagacattaccacagatatgatgtcactaggcaatatgaatattgcaactccattataatcttatggggccatcatggtatatgcagtccctcattgactgaaacattgtgtcgtatgactgtatgtttggtctttgtcccagattcctgacacacaacccataaaatccttgaaacctccaaaggaatgtctttttctgtgctaatgagatgactggtatctggcagcccctaggcagcccccagctccagccccagtcccagcccctaggataacaaggcataaatagagggttgggactttcggccccatcccccagcttctggggagaggagaggggctgaaggttatgttgatcaccaatggccaatgatttaatcagtcatgcctaactctccagagagcttacaaatagctgaacatgtggaggtatttggagggtggcatgcccagagaaggcaagaaagctccagacctgttctcccatatcttgcccatgaatctcttcatctgtacctttgtaatatcctttataagaaatgataaatattagtatttccccaagttctgagagctgctctagcaaattagttaaacccaaggagcaggttgtgggatccccattgtacagccagttggtcagaagcacaggttagacatcctagggtttgtgattggcatctgaaatgggggtggagggggaaggaggagtcatgaagacagcctcaacctgtgctatgtggtgctgtcttcagatagatagtgtcataattgaattgacagccagcttgtgtcctttgcagaattgattctttgcttagaatatgaggaaaaaaactctcacacatttggtcatagaagtctcctatgttgattgttgttgagggagagaataagaaaactgttttttttcccacagatactctctgtccccacacatgcatagccttccctgttattaacactgtgctctctttttaacaatttaccttttgttaaagtgcatcatggtgtatggtgagctggcctgcatgaggaaagagtgctcatttggtcttcaagtttcctcccaactgagaaagaggtgttttgcttttcatagagactaccatatttaggggtcatttccccaattcacttgcttttccccagtagacatttccacggcctctcttcaaagtggagtgttagtgaattttttttcaggatgttgtccacttttgtcaccatttatttgagtttcctagggcttctataacaaatgtccatgaacagggtggcttaaaacaacagaaatttagtctctcagagttctggaagccataagtctgacatcaaagtgttggcagggttggttccttttggaggctctgtggtgaaaccacttcatgactttctcctagattttggtggctgctggcaatccttggtgttccttggccaagataagttaatgcataaaattaaccatcaaaatacttttacctcattatctttataatatccatggaatcagtagtgatggctctcttttcacttctgatagtagtagtttgtgtcttgtttcttattttcgtggtcagcctggctggaggcttattaattttattgatcttttcaaagaaccagttttggtttcattgattttcctctactaatttcttgttctcaatttcatctctaatttcattatttattttcttctgattaatttagttttaattttctttctcatttctgttttcctaaggtggaagattagactattgattttatatctttttcttttctttctatgcatttaataccctaagcactgctctcactgtatcatgcaaatatctattttcttttcatttaattcaaaatattttaaaatttcttttgagacattttgtttgacccatatgttatcaaaaattgtgtttttaatttccaaatatttgggaattttccacctatttttcttattttattgatttctacttcaattacattttggttgagagcatgttgtgcatgacttgtactttataaaaatttgttaaggtgtgttttacggctcagtacatgttcaattttggggaatattccatgtgagtctgagaaaaatgtgtattatgctgttgtttgatgaagtattttataactgtcaattagatccagttgatttatggtgctttcaagttcatctgtaaccttactgatttcctccctgctgaatctgtcaattactgacagaaggctgtgaagtttccaactataataatagatacatgtatttcttgcagtttatcagtttttgcttcacagagtttgatgctgtttttagatatgtacagagcaaggattcttatgtcttcttggataattggccctttattattatgtaatgcaccctctttatatccatgatagtccgccttgctctgaagttgactttgactgaaatgaatatagctactcccattttgattagtgttaacatagtgtatcattccccatccttttactttcaatctatatgtatctttatatttaaagtaggtttcttttaggcaacgtaaagtagggtttttaaaatctactcaggcagtctctatcttttaattagtctatttttctttaatttttataactagaaaaaagttattcataaaacaaaaagccttgcctcttaaaaagcaatgtctcttgttaaattgcaactgattagtcatgctactgagtcatataaacaggaaatttatattttactctagcataaattgatattaaaaaactaatttttattgtaatcaatttacattttccttatttgttaactacaattatttaaacattgtccatttatttacacatatttttgaagcaatatttggctagaatttgatccttctttggctacttctgttagcaaaccaatcaaatgcaagaccaaatcctgataggtgctgggggagagatacttcattaaagagtttttaaaaagaagaaaaatggtaacagatttgaatcgggacagataactcaagcatcattaaaaaggccagatgcacaggggaggcaggaaggttagtcagggcccactgacagctgcagaagtggtcccggtgagatctgacaactacttgaactaagactagtagtagaagtctatagaatagatggataatacaggtgttaagatgatatattaaactatagaatttggtgatggatgagatgaaggccatcaaagatgattctaggctttcagaattgaaagactaggaaaatgctaaaattacctaagatagagaatacagaagcaggaacaggctaaatgtgatggcaattagttgactattatgcatgaggtgccatagtacatctgggtagagatatctactagatatttgaattaaatggtcctagagttaatgggagaaatgtagacctcaggctatatgagagctgtcagtgcaaagacagaagttgaatctgtgaaagcctctggaatagagtcacagttaaagatattggaagttgtgaaagtatattataaccgattagtcattagatttataagtttacaacttaaaataaagggatagccctgtatttgcctacaattagactgagttattcctagaaagcgtttggccatttctagcagcctttatattttgaaacagcctttgctgtggtgactaagagttatgtagttcaaccatgtgagttatatttaggtaaaataattttttatggataaaaaatattgtataacatccaaaactagttcatattgatatcaaaaagtacctgatatttaattcataacaaatttccaaagaacatatgttaaaaaaacaggcttcctagattattcaaaattagctctgggttttcattaatttatggtgttgattaacaatccataaattattaattaaacatttgaaaaactactacgtgtaagatgctgggctaatagtctgtgagatacaaagatgactcaaacataaaatctgtccttaatatacatatggactagtacggggaaataagacacatacttaggtaagtatacaaggagtggagagttagaaatcatagataattttaaaataaagaaaaaattccatttgcaatagcattaaagagacataagatacttaggaataaatttaacaaaagaagggtaaaacctatattctgaaaactataaaatattgttaaaagaaaatttaaaagatacaaataaatggaacaaaaatcccatgttcatggaccacaagcatttttaaacattattacgaaaatgatggtcccaaattagtttatgcatgaaccaaaacaatctcaaaaaaaaaaaaagtaaaatgattcatatttcccgatttcaaacttatccaaagaaagagtaataaagacagtttggtactgacccaggacagatatacagatgaacaaaatggaattggagagtccagaaataaacccatacatctctggtgaagtgatgtttgatgaggatgccaagattattcaagggggaaagacaagttctttcttctccaagtatcacttatttgtggctttataggaaaactatttctgtatcaatttcacaccagtccctgatccctcccaccttggtgcccaaattgaaccatctgaaattttattatatagatgtcactacataaaaataaaattatatatcaaaagtaagaaaataagggaattatgaatggaaagatgttttaaacagataggacaattacagagttatacttaggccaagcacagtgactcatgcctgtaatcccagcacttcgagaggctgaagcaggcagatcacttgaggtcaggagtttgagaacagcctggccaacatggcaaaaacccatctctactaaaaatacaaaaattagctgggtgtggtggcacatgcctgtaatcctagctacttggtaggcagaagcacaagaattgcttgaacctgggaggtggagatttcaatgagctaagaacacaccagtgcactccagcctgggtgatggagtgagactctgtctctaaataaatcaataacattatacttaatatattatcatgtgctcttaccaaatgatgagcatatcatcaaaatctaatgggagaatgaaaacggatcttgagagctataaggaagagaatactcttaagctccccaccacttctctacagtctgtcattacttctgtccatgccactcactggaccatacttactagtatatggagtcacatggtttagtaattgctcagagatatgacatcaccagagagatttagattgcatttaaattataaagctatttaatatactaatccctaaaaaaaggtagtcaatccataaaataaatatcagcaatttcatcagtataaatgattttaagaaaataaaaacataattgaaagacaaaactgatttcaaaactaaacaccaagctacagtaattgagactgtctggtcctggcatagggattatatatcaatggattaccatggagaggtcagaaataaacccatacatttgagttcaatttattttcaacaagggtgtccagacattcaatgagggaaaatataattttcaatatcagatgcaggaacaactgtatagccacatgaaaaagaatgaagttggacccctacctcacaccacgtacataaattaactcaatatgaatcaaagaccaacatgtgagactgaaactataaagctcttagaataaaacatagatgtaaatctttgttgtcttggattaagcaatagtttctttgatatgaaaacaaaaacatgggcaacaagagtaaatgaattggacttcataaaagttaaaaatgtccttcaaaggacactatcaagaaaataaaaaacaatacaaatgatgggaggaaaaaatataatatctgataaaggtctaagatccagagcatataaagaactcttacaactataaaaatgaaaagacaaataatccaatttaaaagtgggtgaaagatttgaataaacaattctccaaaagaagatatataaaatggctgataataacagccaataatgaaaagatgcttgacatcattagtcatcaaggaaatgccaatcagtatcactatgagatactacttcacacccacagagatagctagaataaaaagttagatgataacaagctttggtgagaaagtagaaaaatcagagccttaactgctgatagaaacgcaaatggtgcagcctctttagaaacagtttgcagtttctcaaaaagtttaacagagtgaccatataatccaacaatttgactactaggaacatatcaagacaattgtataaaaacttgcatagccaaacaatggaaaacccaaatgtccagaaattgatgaatggataaacaaaatgtggcatatccatacaacagaattttattgagccatgaagagaaatgaaatactaactcctgttatcatatggattaattttaaaaacattatactaaggcaaacaagatcaatacaaaaagctgcatatcatccatatgaattatatacaagacagatgtgaaatgtccagaataggcaaattcctagagacagaaagcagaatgcagaatagtggctgccagaggctagtgatggggaataaagagttactgctaatgggtagaatatttcttttggcaatgatgaaaatattctagaattagatagtgataatgattgcataatttattgcaggcatacctcagagatactgtgggtttggttccactgcagtaaagcaagtatcacaatacagtgagtcatacaattttgtttggtttcccagcatataaaagttatgtttacactatactgtagtctattatgtgtacaatagtcttatgtctaaaataacaatgtatacattttaatttaaaaagaattttttgctgaaaaatgctaacaatcatctgagccttcagggtgttgtaaacttttttgctggtggagggccttgcttcaacgttagtggatgctgactgatcagagtggtggttgctgaaggttgggtggctgtagtaatttttaaaatgaggcaacaatgaagtttgccacatagattaactctttctttcataaaagattcctctgtagcatgtgatactgtttgaaagcattttatccacagtagaacttcttttaaaattagaggcaatcctctcaaatccttccattgctttaacaactaattttgtgtaatatcctaaattttttcttgtcatttcagcaatgttcacagcatctttactcaaagtaaaatcatttcaagaaaccactttctttgctcatgcctgagaagcaactcatcatccattccagttttatcctgagatttcagcatttcagtcacatcttcaggctccacttctaattctaattctcttgctatttctaccatatctgcatttactttctctattgaagtcttgaacccctcaaagtcatctatgacagttggaatcaacttcttccgaactcctgttaatgtggatattttgacctcctcccatgaatcacaaatgtttttaaggacatctactacagaacaatgaatgctgttcacaaggtttcaattctttgcccagatctattagatgaatcattatctctggcagccatagcctcaaaaatacatggcttaaaaaataaggcttgaaggttgaaactactctttgattcacgggctgaaaaacagatgttatattagcagttatgaaaacattaatatccatcagcactcttgggtgactagttttgcattgtcaatgagcagtaatattttgctaaaacttaaagtcaccagctgcatttgtccctaacaagagagttagtttgtcctcttaagctttgaagccaggcattgacttctcttctttagctatgaaagttctagatgtcgcctgtttccagtagaaggatgtttcatctacattgaaatctgttgtttagtgtagccacttttaccaatcatcttagctagaccttctggataacttgctgaaacttctacacaggccaaaattgcttctttactacttccagaacaccatttacatctttttgtttctgagcttgttttacaaccagtctatttgttagatgataagcagacatctaacaaacaggaagtcactcttcctacttttaaaactgtaacttgcattattcaccaccaatctttaacactcaccaaaatgtaagcttcttgaaaaaagatctgtacttggtccatcattctatccacacccaaacccaacatcacctacacaaatgggtttttcatagtaacttgtacatatcaggccctaaataaatgtttgctgattgaataaactatcacagagattgtccttgggaggtaggagagtggggtagagagcatggacaaagattctggctcggtcacttataaactggataaccctgggcctcagattcttctgttgtgaaacggaggtagtaagagtgtctttctcaagggctgttgtaaggattaaattagttaacacatggaaagcactgagaacataacaagcacttcataactattagtattatggtctccccaagacttaaacacagtaatgtctgcaaagcatctagtccacactgaatgaatgagtaactaaatctgctctaccagtcatgttgacattaataattcattgagactttctttctccttccctcaaatttatcaccttctatgtatagaaaacattcttaaggttactatggaactactcagttggactgattagctgtgttctcttccatgtcttgtgaattaacctccttaagaagagtagccatgttttgttttttgaaaataatataattattgctgctgatgtacttgttcttgttttgtgtgttaatgagataagctcctctatattctcccaccaaaaaaatgtgtcatgagtctgttggatgaaactctccttttactgaatttttaatagcatattattttgcacttttatacacatatagttatttataaatgttgaactagcactagtttgttctctgcccagataacaaaattaaatgagaaatattatcttgactcaaaagattaatttagtagcatcatcaaatgcaatgtccaaattagcaagaaatctaaatggagcaattgccatttactgtgcactattttttttcttgtcaatgggcaaaatcaggaacctctggattacaatgtacagtgtagcacagtatctctttttagtttccatattcctacaagaggtataacactaaattcctcaaggcatcatgccacttcagtatgagtatgtggaagagacagtggagtaaaagtcgggggacagattagacaatttctcccatcttatgaacatttgagagagttttcctttgctattcagtttcaatctgattgaaaagagactaattatctgttaaaacaataaatcaatcacattgtattgatacagctctgaaaccttggaaaaaattaactcttgcagatgacatgattgtctatgtagaaaattcctaataatcaacaacagacttctagaacaaacaagtgattatagtaaggttgcaggacataggttaatatacaaaaatcaattgctttcctatgtaccagcaataaacaactaaaatttgaaattagaaacacaccatttaaaatagcactaaaatatgaaatatttaggtataagtctaataaaatatttacaggatttatatgctgaaaagaacaaagctctgatgaaagtttgcattttcaattgcatcttcttttgcagagttttacacacatataattatttacaaatgttgtcacagtaatactcatttgttctctgtccagataatacaattaaatgatgaaaaaaattaaaaaagagatagtgcatgataatggctaagaagactcaatattgttaagatttcagtaaaaatgtgagttcagacacctcagcaaagcagatatacaaatggcaaaaagtatctgaaaagatggtcaacattgtatgtcattatggaatggaaaattgaaacaacactgagatactatgacaagcctattaaaatggttaaaatctgcaaaactgataataccaaaggctggcgaagatggaaggcattaggatctcattcattgctggtaagaatgcaaaatattacagccactttggaagaaagtttggcagttttgtacagagctaaacacagtcttaccatatgatccagcagtcatgcttgtaggtatttacctgagttgaaaacttatgtccacacaaaaccctgcacgtatatgtttatagaagttttattcataatttccaaatattggaagcaactgtgacacatttttcaatcagtgaaaaaataaacaagttgtggtatatccattcaatagactgttatccagcaataagaaaaaatgaaatatcaaaccacaaaaaatcatgggggatgctttgattcacattgctaagtgaaagaatccagtctaaagaggccacatacagaccgcatgattctaactatatgacattctaaagaaggcaaaactacagagacataaacaaatcagtggttactaggagttcaggggaagaaagagaaggatgagtcggtggataggagatttttaccatatgatttgtatgatatgtaatcacggatatgtgatggtatacatttatcaaaacccataaaactataaaacataaagaatgaatcctaatgttaactatgcacttatgtaatgtatcaatgctggctcatcaattgtaataaatgtgccatactgatgtaagataataagggaaacagtgcagagagagagagagcatatgggaattttctactttctgctcgaattttctagaaacctaagttggctctaaggtataaaatctattaattagaaaagctttaaccatcaaaaatagaaaatttaactcataacaaattattgattacacatagatataaaatacacacatataaataactatgcatctacacacagccaaataaaatacacatctattcaccataagtcttaactatttactctgttattttcccactcttaatgtaatgcttctacagggactaacatggtaaatgggaggtgaggaaatttaggcagtgatactgaattatgcttacaagaaatttactaaaagggaaataggactgaaatgaatagttgtgagaatcttagagtcgaggaaagaattatttttaagctacataattatgtcagctataaaaatatacagttagtagctcattaaattttattctatagttacttcactttcttgtcaagaaagatgaatacttgattataaaactgcataccaaaaaggttcaaattttcccaatgcatgaaaatgtgagtaaaacaaaataatcacataccaataattgatcgatgctgaccattagaacactctcatattgtttgccatctttaccttcaatatcacaatcagatgatgctactggcaacagaacaaggatcaggggaggaagtccaaagatatacctaaaagaaactaaatttgacagtaaataagaatgagctaaatgttatatcgtattgcatttgattgtggggtttcaatggactggaccactaatttctaataattttaaaaatacatcttggtttggagatactacaggaagaacctcaaaagttgaacttatgtaacaaccaaagtggaacagcattttggagtatagcgtcctttcacttttttattttgcaattactctttaggaaagtgcaaaacaagggtgatgaaatcatagactgcttctgaaaaacactccagggtgttaatcaatttgaatttatgttgaacatccccataagaaaaggcatatacaggtaaagaggtgcactacagttcgaagagttacatattgttggaattttatgatgtactgcacgtaattgtatatttttgtaaaccttgatggtagtccatgtctatttgcttcttggaggcaacactgtgggaggttaatctccctgggattgcactgtaactactgtaagtgcactctttctttttaataatgaaccctgaagggtttacattcccaaaagtcttacaaagtttatgtttgtattttgggactactctcctatcctttcactatcttctgtctctgagtccccagagacccagattcttttcaaacacagcgctatccagcttcttgtcatgttagaaaaactctgtaaataaattcacatcctcagatagaaaccaatgatttctatctgtttttgataactcttcccaattaggagcaattgtctaatcaaaaggactgaaataatggtattatttcaggcagaaagatggaaagccagtggttcccacaaacattaaaatctgatcatacagggacctatttcttcataaacctgccatagtgtcttatttgtatctttttgtaaactctgaggcatgttgacaatgtatttcctgtgaatttcccaaatgaacttcaattgtacttgaatgcaagatatttcacttgtgtgccttctctgattaagagtacaagcaacactccttcaaacccaaggaactaatattgtgacagcctgaagactgttagggatatcataaagtttccagtaacattgtcatctattatatcatgatctgtcatataaaacaatcaataacacctcccaataaatcaagtgacccatgttgttacaaatagagaaaattttctgggtagcaattatgaaaacaaacataaatctaacttctcatctgcatatgtgacaacatagtaagagaaacaaaaattgataattttatttatacaaatatattaataactctgccactaagtgcctatatgcatgatgagcatgaattaacttaggagacagataatgatgatgatgctagttacctttagttgagtacctaccatgtgtcaggaactttatatataaaatctcatatatatatatatgatttataaatatccaaaaagttctgcaagttagtctttctgtaacacatacatagtaggtgccaggtttggatgctaacctgaatttgttgctttaccaggattcgattagaaatggccataatctattgataacatgtaatcacatttgtcttctgaatgaagttttgcctctctcttctactcctgttccttcaacctaaagatcctcagtgatcaattgctaatttaaaaaaaatattttggcaattaaaaaaatgtacactcatagatttaagggggaccagagcagatttcttactaatacatatttaatatactgtacagtggtgaagtctgggctttagtgtatctatcacctgaatagtgaacatggtacccaataggtaatttttcaatccttatccccctcctactctcccacctttcaaagtctccaatgcctattattccaccctgtatgtccatctgtaccactgtttagctcccagttataagtaaaaacatgcagcatttgactttctgagtcatttcacttagataatggcctcaagtttcatccattttgctgcaaaagacgacttaactcttatggctgagtagtattccatggtatacatataccacattttctttttttctccctctctttttgagacagggtttcactctgctgcccaggctggagtgcagtggcatgatcatagctcactgaagcctcaaattcctaggttcaagcgatcctcctacctcagcgttctgagtagctaggactacagggtgccccaccatgcccagctaattttttaaaatttgtttttagcagacggctcttactcttttgtacagactggtcttgaactcctgggctcaagcaatcttcctgcctcagcctccttaagtgtcagaattacaagctgtaattacaagcccggccataccacattttctttatccaaacctctgctgatggacatttggatgatcaattgctaattattcaccagattctgaccttgtaatcagatttgtatagattgtatgaaatcatactttttattttctctgtcatcttacaggggtccaaaaggtatacttcgggaggagtagatgatagaggaaaaattatataacatataacttgaaatgagcttaaaggagaatataataaaataattaaatgctagagtgaaagggatacttttaccattatcataaatattccaaaggtccaccttttgttttaatacatgaggttgttttacttgctatgagcattagctgtcttcttcacctcaattttcagtagttaagtgctcctcaaatttaaatcaacctatttattcaccggatggcattttgtgcattctttccaatgagggttgctggaaaattcagtctttttgtatattacacgtactttctcaattttaaaacataatttgccttgcctgttaagagtgttttctgttgccattgttgtcattgaataattagccccagacagactatggcaatataaagcacagaggttttggaattaaaattctcataataataattataatgcatggcttcctgcagtttgtttcaagagatttcactagaagcttgttccattaagagtgcacataatgttactctttaccctttgtctatgccatttcttttgagagttgaagtagttgaggatctactatgtggtctccaactgtcttatctggtttgggtaatttcatcatatttgaggaccaaaaagttgaatagcaataaaaacagactctacttgggaggctgaggcaggaggattgtttgagcctggaagtcaaggctgccatgagccatgatcttaccgtgagccatggccgtaagccatggccgtgagccacgatctactgagcctaggctgagtagtcaagtcaaaacttgagacttttgacttgccaagacaatggtttgtgtgactgtgtaaatgacacagcatctcttaaggtcacttacctgatttctaaaatgaaaacttcagactaaatgatctttttcatcttgcagacaccttattctaagaatctacctggtcctccaaatgcagaaactctttagatctgaaattgcctcacggacaatgctgcaaacatacctagggccttggacccacatctcataggttcccagctctcccattaatgatgtagcttggtagtttggtccataattgaagacctttctcctacatcacatagagagtaacatattaagaatggctggtttgagagtgcttttggcattgttgtcacacccacactccccaccatcctgaacttttcattaggttaccgaaaagataaaccataggaataacgcaaggcaagcgtggcttgtgggattgcccttacttcccctgaagaggctgaaattggagaatttgttttcagtagggaatttggttaaaccagaaggaggtctgtctaaaaattcttgttggtttttaatgtaagccaaataatacattcaatcctcagctgcttaagttatgggggtcaaagttaacataaatagttttctacaatccatcaactccagtctttatcagtctttaaaaccagtgtttactgaatgtccattgcatagacctattttcactgataatttaattccataaccacttcatgaagaagtaggtaagtactacaagttattcacatttatagatggagaatctggggcacaaagacagtcatgtaggaaaattcctttcgtatttttctctctcttttttttttttttgatatggagtctcattctatcatctaggctggagtgcaatggtgcgatcacggctcactgcaacctcagcctcccaggttcaagtgattctcctccctcagcctcctgagtagctgggattataggtgcccaccacaacgcctggcaaatttttttgtatttttagttgagacgaggtttcaccatgttggccagcctggtctcgaactcctgacctaaggtgatctgcccacctcagcctccccaagtgttgggattacaggcttgagccaccatgcctagtcagaaaattcctgtacataatatagatatggaattcaaatccaagactgtcacattgaagagtctagaacctcagcttttaggcactgaactacattgcttccttaaaaaataaccatatatgtgtagtcaaggggattgcataaaaacccatcttcctgtgcatgaacctcactaaggtacttcctggccaaactgtgaaactgcatcatatgcttttatttcagaaaaagagactaaatatttgttcttgttacagtaggttatgtgtcagggttaaaagcagaaaaaaaagtcacatagatgagtgtgaatatgacacgtaagttcgttctatgaaatggccttttccattttttaaaaaaatattcaaacactaacgtgatgcagtttgtaattctcctttatgcttgttcagggtttctaatattagttctctattattattttttgagacagggcatcactctgttgcctaggctggaggacagtggtaagatcatggctcacggcagccttgacttccaggctcaagcaatcctcctgcctcagcctcccgagtagagtctatttttattgctattcaactttttggtcctcaaatatgatgaaattacccaaaccagataagacagttggagaccacatagtagatcctcaactacttcaactctcaaaagaaatggcaaagacaaagggtaaagagtaacattatgtgcactcttaatggaacaagcttctagtgaaatttcttgaaacaaacttcaggaagccatgcattataatcattattattagaattttaatattttgtctgctaatgaaaacttatagcccatgattcatataactgtgcttcaggaagtaaaggctttttctgaaaaatgcacacgctagcttccttttctcagtttacctttctactttagagcagaggtgttgcaaggattagaaccaagggtgatccagaagaagaaactgcagaactatgggcattgcaaggaaaatagggttgtgctcaatttttagttttgtattaagctccgggaggacattccttagaagtcctccataattacgttggctattctttccgctctctctatctttgttttgttactgagctggcactccttggttgtgtcaattcttgattctttacccacgagagtggaaagaagtcttgatctaacggagtagccatcaaaagaaagagcagtcagtttcctattcccgcaccctccccccagctgtcttcttgcttgaggaagtacttactgtaaagcattccaattttcctaagcagatcttttcccctcacaatcctttttcctcttttttaattccagtaagttttttggctctttcattggtcatatatgactgccatccgaatccaaccctcctgaattctgtccctgtccattctaaatccgtattctgcacaaataagatatattaggtctcaatactggtctggaagttagagtcacgcctatttcattctgcctccatcaagaagcgcccgtaggaaaaaataacaacaaaaacaaaaacaaaaacaaaaaaacccagaagctggccttcctcagcgccagccccaggactggtttcccagcaataggcgcaaggtacagcccttgccggaaactcccagtcttactcaggggggaaaaatggggttttccggagacctgttcccctagggtttaaaagcgcgtcccgtgggagcttcgctttcacttctctagggagttctgagctgcaagagcccagctactcgccgaacccgggccgcctgcgtgagtaacttggggcggccaggagcacgggaagggcgccagacagagagcctttggctgcttctgagaccggctgtgggctgccaccgctgagcggcgcggaggctgcagcgttccctctcaggacagaaagcaggcgttggggactgttactcgcagcctgccaggggcagcagccgccccaggttcaagtggctatgtgccaggatactcaggcgcggctgttggctgcccatgggagagccagtgctctccgcaggtccaaagtgcaaggccgggctattcccggacttgcctaggagcaggggcccccagcgcgtctgggattgccccggcgcgtcgggcgcgcgaacttgtgcgcaagggagaagagcgcttaccatggaacatggtctgcgggaggcgggcgtagtcatgatgaccgcaactggagcaggagcaagctctcaccgcccatagtcactcccaggaccctggtcttccgcggagttgccgagtctgtgttgggcagggtgatctctgcagctggttcctcttacccacgccgcgactgcagtttcatccatcccaaggggggcggcacacactacggcgtggctctgcgctttgccttttccataacttccgtaggatccgccagcagtgtactttcagtttctactttgcgcttggtctgcaggttcaatctttgggatcatcagcatggaatcttcattatcccctctctcctgggcacctgcttcccgcgcacctggatgaggaccagaggaattcgcgaatttccgaatcaccgcaggaaaaaccagctggcctgaatcaaagcaattctgggtaaaagacttcccagatgatctctcaacgccttggcaacgcttggcgactgggagctagaaccatgagttgttaatgtgtgcacggaagccacaagtgtgcaggacgcaagctgggttattggaagcggacgacaccaaggaggcgttgccgcggatgt

SEQ ID NO: 1806 - DNA, 72752 bp, Homo sapiens; identical to SEQ ID NO: 1805
  source 1..72752: mol_type = genomic DNA

SEQ ID NO: 1807 - DNA, 72752 bp, Homo sapiens; identical to SEQ ID NO: 1805
  source 1..72752: mol_type = genomic DNA

SEQ ID NO: 1808 - DNA, 72752 bp, Homo sapiens; identical to SEQ ID NO: 1805
  source 1..72752: mol_type = genomic DNA

SEQ ID NO: 1809 - DNA, 22729 bp, Homo sapiens
  source 1..22729: mol_type = genomic DNA
atctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaagttttcttatggattttggattatctgtagcatggtttcaggttattcagttccctaacagacctgagtcaggcactgggtttgaatgcagtttgagaatttcccacatattcagtcattttttttaatgtttaaccaccatgacagggggcaggggatcaatactatgggtggtttataagacctcagtattctcaagaaggaatgcatttcactcccaagtgtagatcttaaatgttgaatgattactctgctcttacaaaaagaatgctcatgtagatgctatgactgtacttgtaggaaaatgtccaaagtaattttaccttgtcaggagatcaaactggattcattttgtttgactttttaagaaatcctgaaagcataactttcaggataaggtaatgtacagaagcaatagctttgtcttcagtgaccagtgctatatcctcagcacctaaatcagtggctagaatatagtagacatccaataacttttgaaagtgttttcaaaatactttagttttgagagatttatgtgagattttaagtaaataactgactagagaaagatctaaatgagtttactcattgaaatacactgaattgcctccacaccaacaaattggccatatgtaataattctttttgggatctaaaaaacttagtaccgagaagccaaccctgcccatacataaacacattgtaattataacaaaactaggcagaagcttctaacagcagcaggaggcatgtgggaatttagaccatcaacttgctcctgcaaattaagccctttctctttaagagttaaaaactatttggctatagacaatatcaaacacatcagcctaatgactcagcttatgcattttgagtcatgtaattacgaaggatggaaatccctagaattttctcattaagggaattgtcagagagtttgacattttttacagtatatgactcactttatgggggatgattattattctatgctaaactttgccttggatttccacaaagactgatgggaggcaggaaacataaatcttactctctttcatgtcatctatactcactagttcaccctggtgatcatactatttttaaaatatataagaatgctagttgaaagctgggttttcactccaactttttaagtttcagattttttagaagatgtataattaccctattcacatgattacgtcaaaatacttcccagtttggggtataggaattcacattcagttgctgcttgttgaaagttgtcaattttctgatcatcacaaggatgatcaagagaagaaagggatactttttaaaaatccaaatcatttacactattaatcaactaactccattcagtaggaagaagacttctagatgacactggcttgcctatgatacatattccacacaatttaaatttttatggataaatatgtctagatacctatttaaatatgaataatattaattattgagcatttaaagaataatagattaactcattattcaaaagctctatgtaatttcaaaaccatagtaattataacaccgtcaattgacataaactttttaaagagaagctcaaatgtttcatgtatattttcagaattagaattcttattttaccttttcattacttatttctcagaaaatattatactcatagctaatccctattaaatccttactgtgttctaagctacctctttgtaaatatccattcagtgattgctcatagcacgagtttacatattagaacacatgtcttagagaagttgcctacctgacagaggaccacaggtagagtatccagaatttaaacgcacatctgtccagctctaacaccacaggtcttaaccactgtgtacattaactactcttagccaagaatttttcagctcacgtcatgtagaatattctttttgtaaaatgccatcacattttataagtcattgaagggaatttttcttggttacaaagcaactctgccccataatatctactgaaaagccagtgagctgcttcctaaaacacagccattttaggtgcaggaaacagtgtataaatggctcattgtatattgtatgctttgccagactgagtggcagtgggagtcctttgttatgtgggtgctgacatctgctagagtgtgctgtctctattgaagaatcgtgaagacaaagccgacccacaggatgtctgaatccaaataataatacatgttctgtgtatagaattggtggaagagaaaatgtcaggacagtgtgaggactgccatgtaaggtcagaaccactgcatttagaaagctaccactgcacagggaagaaatctaagtctacaaaattagtgggctgtctctcattatttcgtgctgtcatcagaaggagggccataccctgctgaaactacataaagagcttttgctggtggcagaactgtgaactggatggattctgggaatggccagaaaaacaaatgcctgtggttgtgagcagtgcccacacccatggtctagctagggctgtttgagatttgttgctttgactgaaccaacctgtcattcaactggttggtccattcacagtcagctttattaactttcccattttccctactgagttatttaagtaaagaaagtgctattcggacagcccttggtctctgggacaatcaactgggatttgattttagtatattctgtctccagtgtaaagccttggaagcatctaatttctagtactgatgaaccaaaaatacatggaagcagtcctaggctcacacttgagcactctgagaatggctttgcttactccagattttctcaggtcccagtgggtgtatattttctgacatatttattccagcctcactttctatcatgtaaaacatacatacaaaatgtagatttcattatagggtctacaaaacagcttaagaaaccaaatactatgtgtgacagatcacactttccaaaagtaatagcaaaaaaaaaaaaaatctggttccccactttcttccagcatcctgctagaatctatcagatactgcgtctatagaagaatctataagaacagaagcagtatgtacaacattcacaggaagtttcaccaaatcggagtcctgccagatctaattttttttccctaatcacgtttgtctcagtcagtagcttaagacaatggaaataatcagtgccacttttaattgggatgcctttttaggcaagggaaagtgacctcttaaaaaagcaaaattctgactgcaagatagctatcattgtccttcatttaagacaaaaaaaatactagggagggaataaattatgatttgtaataaagtgaaaagtgagattaggtagcatggggataatggaaataaagtgtctcttctttgaaataatatgaacaatcaatgtaacaaatgtagcagaaaaaactccagtttaaatacagaaaagaatgtgttcaatgcctctggttctttaactcagaaatatttggaggttacttactcattatgatggattttttttttctattggaaaactctgttagcattgagcgtttttgttttttgttttttgttggttggttggttttgaagcatttttcttgtctttgcccttgggcttttcttccttgaatactacataatccattactatttcatgtctgccacagagtctgctattttattaaggtcatgccatatttcaaaaggatgcatttatttgtttcattaacagctgcatgtttgttcctccccaggagacttggaagatgcagaactggatgactactcattctcatgctatagccagttggaagtgaatggatcgcagcactcactgacctgtgcttttgaggacccagatgtcaacatcaccaatctggaatttgaaatatggtgagggatggtggttttaatggttgcttagacatcctctgtctctcttttcatatgctctttttaatagccacaaaagaaagaatatgtggcctaattaacaaatgttaacatctaaggaattcccaaaggcctcctgaaactccttgtccttcaccaaaaacactcatacaaatctcctctcacggttcagctttcagaccctgagactcagtcaaatgatgctctggatcttggggatcccacatccctcccaacttcatatcagaatttaaatcctgcgtctcctacaacacttctcaccaaaaatctgtttgcccaacacgagacaatccagtgtcttcaagttgcatctgagagttaaactgccttgtttccaatcccaataccagtgcttactagttttttgacctagagaaagttatgtaatgtatctatgcctcagtttcctcacctgtaaaatgagataacctgcctcacaggaaggctgtgatggttaaataatttcatcatataaatcattccaaatagtcggccagtgaataacgagtaatggggaagcaacattaaattataattctgtgaatattgacctaacttctaccatcttgacacaatttgacttcagatgatcctctcaatgtaaattttccaaaaatccacaggaataagttggcattttgtttcacaaggtctcacagaaaagacaaaggaaaagagtctggtttgaaagtttactaaaggtctcagggaactttatcttctccttctccttcatccataagtcatctcttgttgccaagggttactatctctggtgatttgagaaactactctagcttgaaattctgacctgaggctatctccaaattcatatccgaatgacctactttttagttagtgtcctagtgagcaaagtaaatcaagatccaccagtagtaatagaaggcttcctacattccatagacactgagacaattctccacagtctatagtccaaacaagccctgaattccagtttttgtcaatttatgggagcttcctgcatctatttatggagtgctttctgctgcagtccttagataaacatgctgttggacttgagtagtgtactgtgttctctgtctgcctctgttcacttccctaacacattttccaggaataaaatatgtcaaaagaacctgaaccagttcgatgtccacaatctaggctggaaatggattgcactaaaacagccataacaactcattcaaacaaggcactcattttcatgggcaaatcactctcccacacggaggtttgactttggcttctttaaccagctggctggtgggctgagtgttcatcctggtttctcttggccaagctgaggttgacctttctgttcactttcattcacaccatatttgaccacttccttgcccactcaaacatacttaccctttaacatatctcttgacttttcctgtcatattgtaatctgtccagagcctcctctatttgggttttccaattggattcagatatttcagttggaaagggactgccttaagaaagaaacgttttcagtggaaaatatatgtatgagctctttaatagatgaactcctggagttcagagcccttaaaaggatgcccagtttcacaagacagccatacggtcatccttgattgtccattgctcattaatttcattctcaaaatcatgggaatgagctgagaataccattttagatcctccttaaattcccaacagtaccagaaacttgctacaggttggggcctgtaattggatatttcacacatactttccttacaaatatattctatactcaagaattgaactaaaagttattgtcctagtttctccacatcccatgtttacctaaaattcagaaatgggaccccgctcccagtctccccttctatatttatttatcaaatcgtgacaacattaccatcttcagatctttccacctgatgtttgtcctaagcttattccctggtatctgtctagcttacccaaaaattcggtttttatttttatcctgttccaagttgggaaagcctatctaccccaacaaggaacacaactccctagtaactttgagacacacacacacatacacacctactctttaaagcctaaacaatcgcacactctaaaagatagcagttaacaaaagtaacgatttgggagaacagttttaaggaatgtccccaaaataatcaatacatttagccagttaattaacttaacatttcttcaccaatctctagttttcatgactgtaggagcttaaccagtcactctcagaccacaataaaccaaaggtgaaagattctgtaacaaaagctagggcactctcccctgcatttaacctcctggccagctcactcgaagccagacaaacaggttcctctttttgtgcagagtccaggaaccattctcgaaaggactcatttgagcacatgcagagaagagtgtacacacatccagttcaccaagggaagccaacacacattgtgggttgtaggtagtaaaaggccttcctagaacacactccttaggatttaaacaaaattacatcggttaatggaaagaattctttcatatacgcaaacttacccagaggaacttttcttctgcccagatcttcacttccaatttgacccagttatacctctttagagctatttggctgagcttaaacagcacataggaaaaacaaattggtaactgtgtttatcacagaagaggaaaattaaatttagggttgggaaaggaaaataaccctatgatattacttttattctacctttacaatgagaatatatacctttgttacttctttaatttttacattatttacttatttttctttgctttcttgtttgattacaatgcattttaggggtaaaatttatgtgtggtaaaatgcacaaaaattaagtgaatttggagaaatgtctatgacctgtagccattccaatggtaaagatatagaacttatttttcccctagaaggatgcttcatgttcctttccagtcaatcttcataccccaggagcaatcataattctcaattctattaccctttggtttttgccagtttctgatagttcttattaatagaatactctttattcttttctgtcttctttcatttaaccagtgtttgtgagagttagccatgttgatgtccatctcatagctcatcttttcaattgctaagtagtaattccactgtatgaatataccacaaatttttaattctttctcttcttgatgaacatttgtgttttttcaagtttgagactattattttttaggttgctgttcacattcttggacaaatcagtttgtgtatatatattttcatttttctggggtataaaacctcagaatggaattgctgtgtcataaggtaagcatgtatctaagtttataagaaaccgcccaacagtttttcaaagtggttataccattctactctccttccagcgatgcatgagagatatacatcatttgcaacgtttgactttgggatagtatctcgttaggtttttaattcgcatttgtcaaataacaaatgttgagcagcttttcatatacttggtcttttgcctgtcttctttgggctagtatctgttaaaagcactgagttatttgtccttttgttattgctggatatgagttctttatacattctgtatacatttcctttgtcagatagatgtattgcatctattttctattctgaagtttgccattttattttcttactggtgcgttttaataagcaagagtttttttttattttgatggagtctaatatatcatttattttcttttatatgtagtgctttttgtatccttgctaagataactttgcctactcccaaagttgggaagatattttctcatgttttcttttaaatgttctacagttttagcctttatatttagtttttttaattattattatactttaagttctagggtacatgtgcacaacgtgtaggtttgttacatatgtatacatgtgccatgttggtgtgctgcaccgattaactcgtcatttacattaggtatatctcctaatgctatccctcccccctccttccacctatgactggccctggtgtgtgatgttccccttcctgtgtccaagtgctcttatcgttcaattcccatctatgagtgagaacatgcagtgtttgattttttgtccttgtgatagtttgctgagaatgatggtttccagcttcatccatgtccctataaaggacatgaactcatccttttttatggctgcatagtattccatggtgtatatgtgccacattttcttaatccagtctatcattgatggacatttggcttggttccaagtctttgctattgtgaatagtgctgcaataatcgtacatgtgcatgtgtctttatagcagcatgatttatactcctttgggtatatacccagtaatgggatggctgggtcaaatagtatttctagctctggatccttgaggactcgccacactgtcttccacaatggttgaactagtttacagtcccaccaacagtgtaaaagtgttcctatttctccacattccctccagcaccttttgtttcctgactttttaatgatcaccattctaactggtgtgagatggtatgtcattgtggttttgatttgcatttctctgatggccattgatggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcaatggccatcagagaaacgcaaatcaaattgtgtttatttgtttctcttgtcttatgcattggctaaaacctcctgtacaccactgaatagaaatggtgaaagtggatattcctgtcgtgtcctggtcttagggaaacaattcatgttcacaatttcagcactaaatatgatattaactataggcttttgtaaatgctctttatcagattgaggaagtgtctttctatttcttatttgctgtgagtttttaacatgaatagatgcattcatgttattaaattatgctttgaatgcattgattgattataaccaggttatttatgtcttctagtctgttaacatggcaaattatattgattaatttttgaatctttaacctgctttggtttcctgagatgtgccctactttataattatgtattaaaattagtgtgttagtattttcttgtgaaagtttgcttatacatttttgagggatatttgtctatcaacttcttttctctaatattttggccaggtttgggtaccaggattaagctagcttcaaaaaataggttgagaagggtcattcctcttccagtttctaaaataatttgtgtcagattgacactatttctttccttatacatttgatagaatttaccagaatataaccatcaagcatagagttttctttggggggaagtttattgataataagtttaatttctttgagagaaatataactgttgaaatattccatttctatgtgggtcagatttactaatttgtgtttataaaaacattttcattacatctaagttattatatacattaaaatagcatttaaaatttccttattatacttttaacatctgcatgttctatagtgatatctcctcttacattccagatattagtaatttatatattttgttttcttaaccactcttgttagggttcaccagccaaaattacctataaaaatccattacgttacccatcaagtatatgtgatattatgtatataaccctttatactatgttatcattttctttaacactttttttaatcaatattttttacagctcttatttcttacatatattcctatggaacatcaaaaaaagcaattactttttaatctaaacaaagtatttgtttttcagtgatcaattataaaaatatagaaatttcccataattttataaatatgtcttgactatttcaggttcaattgcatctaattctaagtaaatcatcactaagtatcatagcagcagaaagccataagattttaattcattatctctcattcctgaacatgcctccactcacccacccacatacctatgaacagagttaaagtcaaacatacatcaatgtgcatatgatactattccactgcatacaggaactcctacctgaatcaagacatatcccctttttattcctacagtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactataggtaagaagttgtatataaaagtatggttgtcacttttgggctacctgaaaacactgtgtctggacattctgtaggttaaaagtagacaaatagtggaaacaactggcaatagataatagctaattccctactgtaaatttttataataaatgaaaagcttgaaatttatactttcctgcagtgaaagaattctgaggatcttcaaacccaggtgtgaaagatagtgtttgtgcaaacctacatgaagtggctaactggagctgggcttcctgtcatccatcacaggtgtcctttccttccttatctgtcctttccttccttacctgtccttctcccaaattccttgtggtcttctccccaaatccccacaacattctgagtaagtttagctaacttatcaagttattttaaaaagcatatatgccttctctattagtcagagttttctacaaaaaaaaaagggaatcaataggaggatagatagatagatcattgataggagagatttctattaagaaattgacttttgtggttgtgggaactggcaatcgcaaaaatccataaggcaagccagtaggctagaaattcaggaaagagtgcagtattgagcctaaattccgcagggcaagaaactcaagcagattttctgtattgtactcttgagacagacttgcttcttcttcagggaacctctgtctttgctctagaggccttctactgatgaggtgatgcccaccacatcacggaaggcaatctactttactcaaagtttactgatttaaatgttaaccatgtcttaaaaatacttttagcattccctattcgctcccccttcaaccctcaaaaagaaaattaaaggtaagagagcaatactcattagagataagaaagagtaagaaacctagctcagctttgtctcagttttgtttcactaagatgataaaatagagaggtaaagcagaagttccatgtgtgaacaattaacttgtgaaaaggcaaatgtagtagaaaagagacattaggcagatggctgtgcatgttggccacacagaagcagcattggccatgaccagtgtgggtcctggttaggggaagagaactggctttgacaacaacagggtatctctgaggttataaaaagttgggttctgatcatttggagatgaggtccctatggatagggcaccatatctaaaggttcaccatttacattgcaaatatacattcagttctctgagagtgagcagagaaggcagaggttctcagtcttctgacaaggtcctggagcatcaggggagagcccattcttacaaaactccacaccagcatgcaagcccttacatgcacataagcactcacaacacaccaagagcctccaggtgacatctgccacctccaaatccccatatcccacatgctcaatgcacttgcagtctccatcccccagcagactgcaaatctgacatgcctcctccgaacggcaagggggagaggtacgtatggtacacacactgctgatggcataggcccctttggaaggggtagtgtgagtctcttggggctatggcaagcacccctggacaagcaggaagagaggtggtggaggcatgtctcacggtagcatctccttctaggtcctaatgggacacttcattaatggaactaccatttaagtgagtttaaactggatgcttctgattgagccccagagccagtgctccactgccaccacctgcaccctcacttccccttgtttaagcatcttccaacccagtaaggctgaagagggaagcatcctgccttcccacttctcttagcagagtagattgatatgattattcagattgtacaagaatctattccctctgaagtattgcttgatgaatgagcccctttttctaatttgctcaaagaaatcatttgagcttgaggaaaactgtccagagggcacgaggaccagccgttgtgatatgtaacaaggtagagaaacaaaagctaaatgaagaagagtgagcctcagaatcaaagaactggatttggatccctttaaaccattttacaggggcctgaatgtaattaacttctctgaaattcagtttccttatcaatatgctggtgataagtgactattgtttgaagacagcataagcaaagcatgcagtacttaggagatgtgttcttccttcaattcctctattattaaaagatgggcacagggcaggggcttcagctcagaaggccttgttgagaatggaatggagagcaggaacaagagagaggggcaaaggcattgccagcattctctgttcggctgttctccacccactgcctttcctcctgcttccctctaagtccagggcattttcccttttgataaacttccccttttacaacccatccaagggtgaaaaacaaagtcattacttttttttcagtacctctaaggcaaagcagcagaaacaggcagtcaccactacgaataagtgactacaacaagagctaggccaaactctgccatgtgggctgcattttattgggccggcaagtaactttaaatcccagctcacactctactgagtgaaagtctgatgaacccgcatcttcttgtgaacaactgcgcctgagatcagtcatgcaagaagtagcacccccacccccagacaactaacttcccaggctgtgaccaacaagcagccaagaggccaggacagggaagtctcaggacctttctaggaaatcaatacctttctctgggtttgttctgcctgaaataataccaatctccctccaacagcttagcatgtgtggagcatttgatactaacagcaaccctgcaaggcaggaaggcagtagggagaggcccaagaggaattcagcattaaggcagtgagactgacagaggggaccccctgaggacattctggaaggtcttagccagggccaggatgcagacccttcatgtcactgtagctgagacgaggtgcaaggttcacagcatataacctaattttattacaagaataaagactcagagtttaaatactcctgctttggggctcattagtaacaagttctccaatattcaaaaggcaaagtggatgtgttttagtgtaaaattaacactagctgctgtaacaaataagcccccaaacatatgatatctcaaacaccgtaggtttatttctcactcacatcagagtcaaaatggatgtttctaacctgcagctggggcttctcccagcagtattaggggcactttccatcttgtggctccaccgtctgtaatgcaggactccaagtggtggaagaggacggagcagaggagtcacacatgggtgtgtgtctggcccagggtggaagtggatgtgcatttcttctgcccacctcactcacaaggccacaccccactgcaagagaggctggagaatgcggactggatttaaacccaagaagaagaaatggttttctgaatagttggccatttactgacacaaaaagggtcaaagtgacttgcagaggagatgaattttaaatactataattatttccttggctgccctttagacagaatttatttctttttcttttccagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacggtatgtagttcaactacattaataaaataaaaacttatgaatgttttctattttgttggcctagtagtgcatttcccctgggagggcccaacaattttgctttcaaaatctaccttctactgaaagaatctcccaatattggccccatgaaaacctggatcttccctgatgcatactcttctagctctggttgttttcttctgctctaattttggtcttcagaatgtttctacattagtgagttggataacaatatagattgaggccaaattaatcctctgtattcaggggcctcaaaaagtgtcatgtctagtgccactttcataggcaaatcaggcaaaatgtatatctgcttatgatcaccaagtcgtagccacattctggcttatgagattcatgggaccagcatgaggtaaagaaaagaggcataatgtttgcctttgttttgtttttattttaaagcccaaggtctttgtttttgaagtaacagcttaatttttacccttcataatcaggagagttacttagatgctctcttcatgatttgttgaggttggaatgatttggcagtccctgaaatttattttggggaggaggtggcagaagagtggagtgtaccaggttatgagatttctcttaacccaccaacctaacttctgttctttctgcacctcagagatgaagaagagatgatgatttctcttcctcaagtccttcttattcttgctgtcctgttttttcaggccaagattggccttgtttgtttgcagtgtgatgcaagatgccacttgcataaatgtaacaactgccccaaaccacctgctccctccttctactcacccaccccacccttgatcctgccatctttcattattcatctgaaaattgcaccaattgaaaagcaacttagtggagaaaggaaggattatgaataaatgctgccaggacaattagttaactaaaaagaaaaatagataaattcaataaatacatgaatttttttgagatggagtcttgctcagtcatccaggttggagtgcaatggcgccatcttggctcactgcaacctccgcctcccgggttcaagcaattctcccatctcagcctcccaagtacctgtgattacaggcacccgccatcatgcccggctaatttttgtatttttgtagagctggggtttcaccatgttggccaggctggtcttgaactcctcacctcaggtgatctgcccacctcagcctcccaaagtgctgggattacaggcataagccaacacgccagccaaaaattgttttaattaaaaaaaattaaactaaatgcctagccaccttcatataacaacaacaaaataccagatgatttaaggaaattatataaaagtgaaactctaaacaaattagaaaaattatagccaaatgtttacataatcttgacatgaagaagaacattctaagcatcaaagctgtagaagaaaagaaaggattgagacatgcaactacataaaaagtggaggtttatatatgtcaacacacacaataatcaaaaatcaaaaatgcaaatttaaaagtaagcttaaattgccacataaacagctgatagatggttagtatcattaatagataaaggactcttataaatcattaaaaaaacaaatatcacaatagaaaaatgagcaaaaaaattgggaaaaatctcataaagtatggaatagataaattcaataaatatatgaaaatgaactaattatcaaataaatacagatataaatagcaatggacttctttttatctgtcaaattgatagagtggtttttttttaatcttaaagataatacactgtgtggtggagacttttgtctctttatcactattcacaatgtaaaatggcgtctttctggagagaaatgattcctgctcactaacctaacctaacctttcatctccccttaatatgtgaaaggatagagagaaaagaagaagatattgaagtgtggaaagggagatcctgggcagtgcctaactcacctgaataagacccatcatttcactctcctccttgaccactcacaacatcctttataagctcagattctgtccctaattttgctgttgactcctttacgtatcagagctccttattctaacaaatacgagacaacttcagagaatgcttatgggactaaaggaatcccaattgaaatgatttgggagatttaggcaacacctcttttcccatcctaagaatgtaactgcactctactctctagcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggtaaggaatggtggtagagtttttgttccctcagagtgctttgcatgtcaaagtgtgggagcaagtgagaggaagattgttgaaactaacctgcaaaataggacacccttggagggcactcttacactttctttggagaatgacttgcctgctgtctttgcgccttttgtgaagaacaaggaagcagagggagtggggtccttattagctgagaattagtacaagccatctgtattcctggaagctgccatacattttgaacaaaatccccacccactacgtccagttaaccaatttagcctgggaccccaatggctgctgtctctaaggcccctttaagaagcacctttattggtgtcaggtatgcaggcaagtgcggctgtcctatgtctccttttccagaaggatgaagatgtctttgggactggaactgagaatgtgtaggaactgagacatctcctccctaaaatttgcaacaggggtgaacatccctctcatcatctcctgctctggcttcttttccttggtagaaagtcaagaagggaagagagcattggtacctttgatgctagatcacgtttacatttcaagtggcagatgctctgggcctggtcacccaagtcaatgccttttaaaccaaaatccctccataaagctgtcaaatatgtctcttaactgaaaagcaactttcaggaaataataagtgggcccacattactaagtaaatgcaaagcaccctgagaccctacccccactgcatggctactgaatgctcaccacaatctattcttgctttccaggggagatggatcctatcttactaaccatcagcattttgagttttttctctgtcgctctgttggtcatcttggcctgtgtgttatggaaaaaaaggtgaccttcttcaactaataaagagggtgattgtgtgggatcacggacagtcagagcttaagccccatttattgatgagaaaaccacaaaggggattaaggcatttcacgaatttagtgcccagtatccctatctatcctcagcgaatttccacagttaatttcataagaggcaaaaagatattaactggacattaggcaaacgctgtccccaaagtaagaattccgtaatgcaatgtttcccaagcttttcttccagtatctcctaaaggttgcagaagccatcattcatggcaaatgcacaatgtacttgaagtcttgactttaagcatataaattcatgggattttttatactaatccatgctaaggctatgtttgtttcatcataaaaatgatgttttaaacatgcacttgttaaattacttactattctaggagaatgcccttggcagaaggctacatatccccaggattacaaataccctaatttgaaaagtactgcctggaaagtactaagcaatttccctgggtaatttgaaaatattcccccacttccaccaaaattagctgccagagttgctgtcagtaaagagaagaaataaaaagacaacacttaaattgggagtaaacaacggggttaaatttacttccatagctgcaccaaaattacctccttgcaagccttggtgttccttccctctagggctttttcccagaggtatattattgtcatgtcttgttcacagaatggattgatatctgtggtctctggtccaacccctccttgaattgatagggccccgaggcccagagaaagccagtctcttgaccatggtcacccacctaattgtgttagagccaagactagaaatctgttcttctgattccaagctcagaataagtgggaagactcagtgtgcctgtgccctctgccattcacttcatctatcaatgttctctgatttcaggattaagcctatcgtatggcccagtctccccgatcataagaagactctggaacatctttgtaagaaaccaagaaaagtgagtgtttttggtgcttaaaaagtgttgtgttggcaacatcccagtggccaagaatgatattccaggacaaggaacagttgaacctcaccttttggtatttgattcatcctgtaactagggtccctcctaagaccctagctgcagtagggaactgaaataagatacacatctcagaacttctgggctccctggggctggagggcacagccagtggtcacttcaagtcttgaagtgtctcagaagctccagaagcaaagagtccattgaggaacatgctggcaattctgtgacattccctgtcagaaaactctatagacctactcctgaactgaacatttgatggtgtgtctctctggtgccatcttaataccctttctcctttttctgtgcagaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttggtttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaagatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctcttgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaaca

SEQ ID NO: 1810 - DNA, 30600 bp, Homo sapiens
  source 1..30600: mol_type = genomic DNA
cccgccccttcgcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggtgcggtggctcatgcttgtaatcccagcactttgggaggcccaggcgggcggatcgcttgaggtcaggagttcgagaccagcctggccaacatggtgaaacccctgtctctactaagatacaaaatttagctggcatagtggcgggcgcccgtaatgccagctactccgggggctgaggcaggagaatcgcttgaacccaggaggcagaggttgcagtgagccgagatcgtgccactacactccagcctgggcaacagagggagactccgtctcaaaagaaaaaaaaaaaaaaaaaagcaaaccctgagaaagcgagaaagcactttgagcatttagaatgggaacaaacggcgctattagtgcttcaaaaacgtaactgcccaaggcccctggtaagcagaggatactaaaatctgccttttccctttcttggagtggtccttgaagagggctatcgggaagttcaaatttcttctgttttcctgcagagcgttcatttgaagtttgctttctacctctccaaactgagcttctgatattccaggccaaacttgctccttcctcagccttctctatctcagtaaatatcggtaaacttggttatgctgtcttctcactctccacatcagcccatagctttctattggctccacctcagaatcctaggacttctgcacttgctctgctacgaccctggtcccagcctgcagcacgtcccacctggcttattggtaggctctcctaaatgcttctttcttgcttctctgtccttactccaacatcctttattcccagcagccccagtatccttctaagacatgagtacagagcatgtctcttttctcaaaacttccagcatctacatctcacccagaggataaacaaagtcaatacaaaaactctaaggcccttgaagacctggcccctttacctttctgacctcatctgctacttgcctgttccctcctctgcagtctcaccatgtccttgctgttgcccagtgggcccagttccaacctttgcatttacatttcgttttgtccacaaacttttcccacagatagtccagtggctggctttctccttctttttgacctttaatcaaatggcaccttcttattgaggcttcctgtgactaccatatttataattacaaccttttctctatttcgttttgttctttcatttcacttggcaccatctaacatactatagagtttatttatttgcttattgccttccttcctccattagaatataaactccatgaattcaggttttggttttgttttgttttttttctctaattttcctaatgcttcatctccaggggcctggagcagtatctagcacaaagtagacactcagtaaatatttggtgagtcaatggtattatattttgttttttaaatatatgcaaagcattttcaattacttactgttgtgttggatcaatgttcaagaaagatatgttaagtttaatttatggtacaccagcacatatcccagtttgtaataggcagccctatctaatttaatagctctggaagccctcaccagcttttgttcataatgatgatgttaaagtatctaaaaataaagattaatggttatacagcatattttgctaagaatatatggaagtaaatagtgtattttagaaaggatataaatacattaaaattaccatggttgatcaaataagacagccaccatctcaaaagcttagctattttctcagacttgttatttgtacgctttcagtagatcctcactactgttctggaaattgaacctaaatacagtctgcacatatctttaaaaataatgtgatataagaataatttctgccaggaaataataattgctcctttttttttttgaccacctattattatgtgacaagatttggccctttgcatgtgttgattttaattcttacagcaattcttaggtattactatctctgtttttcagataaagaaaagcaaggtgcagagaaatgtatttactagctctggtcacagttggctttggttagaacttaggcctgtgcaacctcaaagttcatcttccctccacccctgcacaatcttttcctctgatcaaagtgctaatgaagcagtcttaaaactttattaacacatttgacaagaatcttttgccctcctgttttgggcacagtactttgggaaggcattggattccataagcaggtgcttattttaatatatttctcaatcaccaccccaccttttacacttgtctgaattgtcttacttgaaaatatgaatgggttttctttactatgagagttagtggtatgaggaaacagtcatgaaggtatttacttatttgtaagcaacatatcctgttccacctgtgttaatcctaagtgtactaaagtaaatcttgaagaatttgaaagagatgacactttttaagtttttttttgcccagtctgttttcattattgaaaattcagaaaagcaaaatgaaaacaaaactatcataaaagtcatcaccaagggataaccacgttaatattttggcttatgttcttgtaagtatgtggttgggagtggtatatgaatatacatttaaagtaaaattttaatttctgggattttgaacttctgggcacatgtgtggaggagttgcagaaggccttctttttcctagtatccctacacttatcacctctgctggaagcctgggtgcaggagagctaccaaatttatccctggcctttagatagtctgggttttttcctcaattccttgtattttgctctaatttataagactactaagcagttctatcttgtctagctttgtcaatcatgttgtaccttacagtagagagaaatcttagtaaggaaaaataacttgaagagagcaactgcagagtctataggcaacctagatacaatttcttaattaaagttaaaaagtcatcagcctttcattcaacacaaatgttgtgagtcgttgctgaggtgaatttggttgggtcctagctcaggagagcacccatctaacagagaaagcaaacacataaacagtaaaacataataattattataacagaagaatgactaggtgacattttggagcaaaagagatgacaatcaggggaagctaacagtgccttttgaattgggcttgaaggaataataggcatttaccaggtggcctttaaggtatgtgggctattcttttacctggccctagatgacttcatttcctgtttcacagaaaaaataacagtatgtgggaactcttctcccttcaaatatatctgtatttaaacctctgcttccttctttctagattcaaaagaggtttctctctattcaaggctgatttcttcaccctatatgctattcattatcccatttgtattgccaaacagcttaagtcttaaacccttaacaccaacagttctcaaaagtctggttggagtccctaatgctctttcaggagatttgtaaggtcaaaatcatgtttagttaaaagattcattcagagtgcaatggattttaatgttccaagttaatttatacagcttcagattcctcattgcagcttacctttaggaagttatttcttgtcaaattttagtgtagtatcaaagagaaatatctactactttgtgaaaaggctattaaaatacacctttctttataactatatgtctgtgtgaagctggattttcttcatatacatcaaccaaaacaacatgctgcagtgggttgagtgcagaagcagatacaagaattcagctctcttctattaagttaaatattgaagagattagcaaaactttaaaacaatgttgttcttctgtttttgaggaaaaggtaattattttattaaaatatatatgctaacatctatatttatgattattttaaatgaattaataagtaatttttaagtttctcagcatcaatttattatggtaaatattggtagatataaccaacataaacaaaagccctttggggtctacaatagtttttaagagggtaaaaggtcctgagaccaaatttgaaaactgctactctcttgcatgctctcctccctctctttccctacccctccacccccattttccctcccctcatactcctctctctctctttctccttcccttcataaccagacttcttggaaaatctgtttttgccattcactcactttttcactatagctgttcccaagtcaccaatggccttctgatttcagagtctaacatatccatcagtgtctatttgacctctctgagtcttttataccaacctgccaccttttctagaagtctctggtatgctaccatcctggtttttttcttgccttcatgactaagcagtattttttaaaattcttctttcacatcattcctttccattctaagcattcctaataggcaacctcattttattgttgcttcaactgtatatgtgtatatgctcttaatttgtatgagggcatttcaaaaagtttgtggaaaaattgaattaaaagataaaaaatgtaaactttggctcagcactatggctcatacctgtaatcccagcactttgggaggccgaggtgggcagatcacctgaggtcaggagttcaagaccagcctggtcaacatggcgaaaccccatctctaccaaaaatacaagaattagctgggtgtggtggtgcacacctgtaatcccagctacttgggaggctgaggcaggagaatcgcttaaacctgggaggcagaggttgcagtaagccaaaattgcaccactgcactacagcctggatgatagagcaagactccaaaaacaaaaacaaaactgtaaactttatttctgaacataagcccatgaagttcaagacacttttgtaagcgataacaccagccatttgggccatccctaaagaactgagagtcctgggaatttaaccacatcaatgaagtcttttttacattattaactgaagaaaaatgggtgctctatgaagatttttcaagattgggaaacaaaaagaagtcagaaggagacaaatcaggactgtaaggtggatgcctaatgatttccagttgaaactcacagaattgcccttgtttgatgagagaaaagagcaggggcattgtgatggagaaggactctgtggtgaagctttcccaggtgtttttctgctaaacatttgactaaagctgtaacagaaaagctttagtttagaaacacttagaaaagctactgtttctcaaaaccctctctaataagcagatgttaccattctttttccctccagaaagtcagcaagcaaaataccttgagcatcccaaaaacctgcagccatgcccttgcttttgactgtctgcttttgctttaattggaccactgccactttgggggagccattgctttgattgtgctttaggatcatactcgtaaagtcatgtttcatctcctgttacaattttttgaggaaatggtttaggatcttcatcccacttgtttaaagtttccattgaaagctctgctcgcatctgcagctgatctgggtacaacagtttgggcagccatcaagtggaaagtttgctcaactttaattttcagtcagaattgtataggctgaactagttgtctatggtgttcactgttggttctgctgttaattataggtactcttcatttagggcacaaacgagatgaatgttttcctcgaaaatcgatgtggatggtctgccgcagcaggcttcatcttcaacatcatctcatcccttaaaatgagttactgatttgtacactgctgattttctgggggcattgtccccataaataaagcatcagtgatttcaccattcttccaaccaacctccaccataaatgtggtgtttgttcttgctttagttttagcagaattcatgttgctgtggtagaggttcttttcaaactgtcttattcttctcagtgtctcaactagatcctgtttagacatgaatgataagttagtatgagtttattttggaaatacattttgcaaaaaaaaaaaaattgaaatccatgcatggtttttgcacgatatgcattttccatgaactctttgaaaaccccttatatatgagaatacttacataatgagcattctttgctgaaacctctctcctaagctccagaccacatatataagtacttggtatgaaggctcctagatagtgccaaaggtagatatttcacatttaacatgagccaaaaaaaaaaaaaaaacttcattctatctccctttcttctaatcgctcatctctagtgaaattgttttgatttggcctcctaaatgttttgacgttttacctctccattcccctaccctatactttttccaagctctcctttctgctcacctggattattgcagaagttttcaaactaattttcttgcctcaatatacatccctttgatttttatccagaggaatccacttaaccatataagattatttaacatccctcctaaaaatcctaaagtggctctcctgtaacttttagtttataagttcaaactctttgtcttagcacatgaggtacatgatgatctggccctgctacctttccaccctcatctcttctcacttaatcacaggcatcctgtggtccagccatagcaagctctttgcctgagacacacatgctcttaccttttcccatgctattccctctgcctggaattttcttttgggcttatcctcattccctttcattcatccttccaacctcctactccaaccaaatctgtcttgatatccctattccagactgcctctgcttgatgccccttttctgggccccataacattcttgcagcatttatcactccctgtcactgtttgtatcccctggtatactgaacagcttggaaacaaagattttctcttctctgtgctcccacttgttagtacaaagactgacataaatattttctgaatgtattcatgaatgaaaggaaaggaatggtctttctgaaatagagaatggcatgaacaatgcattgtgttataaaagcagagttgtatggcatgacttttggagtcagacataattgtaagtcctggatctctcacttaccacctttgtaaaatagagatgataaaactgtactgggaaataatttagttgttccaaaagtaaatactgaacaataccattatctacagtatgcaagtcactaggtgtatattcatgaataaaattagcatggtcctgaactcatggatcttaaaatcgaatatgggagacagtaaacaggtaaacaaataagtatatgattacaaatacattgtgcagtgatgaaagataattaggtgaagggcagctagacctatttagatgtggtcaaagaagtccaaagagaagaagtgaatactaacatagaagcctctgatacagagaagcttttcgctttttactctttttgatagttttagaatgttgttccatatgaacacattatttactctaaaattgtatttttaaaatatatatagggaagcaaaaataattgacagaagaatatctgagtctatttgtcttaattggaaggaaagatcatttcctattgagaatgagggacacgcagaacaaataaaatccacatagaaagaagtaaaggtatgaaatagtcactaaggactatgagagaagacaagtggaaggattaacggcagtgttgaaggccctgtggaaagggggttaccataaatttgtattcacatcagcaaccctggtgtacaagtaaagttgttagatttatccctggctgcagctctccaggatggagtagcagaagtaaagggggattgcagaaataaagattctgtctagagagtagttgaagtggtgaagcacaggttttggcgtagtagcaaatgaattgtggtcaggcagatctcatggactcaaaaaatgtgcagaggtcaaggaagagcaaagtatgtgaaaagtgggtgggtggaccatatctgttaatgctacacaaatcatttcagtacgttttttttttttacttctaccaaagaatgttgcataaattttaattgtaaataagtactaattgagaaacataaattgaaaggtaaatgtttttattaatagatttgatttctgaatatgctaattctgatagtttgttgatattactcttaagaatttttctggtaagttttttgcccctttctataaattttactaggaaaatatcagtgtcagaaaaaagtcctccgatttttattgctattaatgggtggaaaaaggaagcaaacccagaggataattggacaaatgaattacaattttaatttcatcttaggatatcaatgacttgactttggaatgtttctttattatggtataatcagttgctgacatttcatatgatatagcaaagtgtgatatataagcttacagatgtcatctctaaaagtactgtaaaattttaatgagatttttccatattttaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggtaacagataaaattctttgtatttttaaattcttacatcacaatatggaatgattaattggtataagtactgtctaatgtggcagtttagaaagtaaacctctccactatggaggagacattggtagtaggtaacctctttttgattgttccttttgcagttttgtcttctttgtcccatatgtcaatagggctaatactgtgatctctcaaataagttttttgggttagaatcaagattcccacctttgctgtggttccctgtttggcaagccaagtgaagttcactctgcctcacacttctcatttccagattgaaggaaaataagaatgttacaagaatgtctggtaaaaatctagagcttaaatttcaaagtgtgtgaatctctaacacactctaacaatgtattttgggactttttcaatttgacgttttaaagttgttgcttacaagtgtacacttctgtgcacagaattcttaaatcttagctaggatttctcagtgctgtcttcagataatttcaatttttcctttttactcatctctgctcaatttagtgtaaaatatgcatgcatattttatttttgtcagtcattgcagttaaaacctatgtcaaaatgtttctttggtagcaaaaggaaaagaagactatttgttattttcagcattaatctgggaaagaacctaaaagacttggctcccttgcaggaaatatttcctcataagaagagcgaacatgttaaattacttgaaagaagcttaagtttaaactgtgttaagccaatgtttaaagataattttttgatattactgttaaaaacttatggaagataattggggcagtggtggcaggaagataaagctcttctcttttttttttcttttttccaagactcattcctgtgacagaaaaagcttttctttacagaataatacctgcaaataattgtgaaaagaatggtagaatgagaaaaatacctatttgcaaccaccaatgagtaactgattcatgcaaggctcatcactgaacctaaaagcataaggtgaaaggtggttgttctcgtgcatgtgagcaggatatgcacaagattttaaagtattataggctgagcacagtggctcatgcctgtaatcctaacacttgtggagaccgaggtgggcagattgcttgagcccaggagttcaagaccagcctggacaacatggtaaaaccccatcactacaaaaaattagctgggtgtggtagtgcacgcctgtagtcccagctacttgggaggttgaggtgggaggatcacctgagcccaggaagtcaaggctgcagtgagccatgatcatgccactgcactccagcctgagtgacagagcaagaccccctcaatagatagagaaaaagtattgtacacaaattacttgtgaagtatgaaagagaagggtacatttttaatgaggaaatctgaagtacacttccttcaccaagtgatcaaactttagcaccaataataatggtacaaaatgctaatatgtacccctggatgtgatacaatgggaaaggcacattatacctatgtagtatttctaccaaaatgcttaatctgaatttaatcatgagaaagtagtcagataaatctaggctgttagacccattctataagacatctggcccgtattctaaaacacacacacccacagacacagattgaaagagagaatgcacaagagcccagatatggcacaattttatcaattattcaattggtgaatctaggtgaatggttgttcattctatcattttttcaacttttctgtaagtttgaaatttttaaaaataaaatctttagaggaaaaacagaaagaaacaatattggttaaatttttaaatgttacttttcaaaactaatttttgattttaaagaaatggaaagaaatgggttgaaagccgactttgtgatttttttcaatttaattgaattacagttaagatcaaaggaataatttcctaagtttttgtgtgttctgtttctttaattaagcaggtgcatttattaaaaattatatagctatcagagtcttaagtcatgtgggaagtaatattgctagtagattaagaatacactcttttgtcaaatgagatctgaatttgtacctcaacttggatacatcatattggctgtgtggctatgggctggttactctacctctccaagcctggctttttcactagtaaattcatatgataatcataatatctttgaacatgctcatgtgtgtgcatcctataacccactaagtaaatatccagtaagtacccagtaaattattatcatcatctttggcatcttttttcctcctatctttcctgtctctctgtaattcttgctggttctcttgttgtcccttttctttaatgttgtaggagatgctgtgggcaaaatgggcaggggagatcaacacctattttcatatgacctcagtttataaatgctattgtttgaatgtgtccccaaaagttcatgtgttagaaacttaatacccattgcaacagggttgataggtgggacctttaaagggtagttaggccatgagagctttgcccttatgagtggattaatgtcgtcatggcaggagtgggttagttatctagggagtgggtttctgataaaaggataagttaggccctatttttctttttctctctctctctttttttttctctttcacatgcacgtgtgcatgctcttttgcccttctgcccttccaccatgagatgatgtagcaagaaggccctaaccagatgcagcctctcgatcttggacttcccagcctccagaaccgtgagccaaattaactattatttataaattaccctgtctgtggtattctattattgcagcacaaaatggactaagacaatagactaattttgtttctttgttacttacttttaaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccaggtaaactgattgtgaccagggtgtccacaattagggtggaaagacaaatggcagaaatataaatgtttcttcttactcttccttttttctcatagtagatgaagcttacatttgagagtccctttctttcagcactcctcaactctttaaaaagcagcacagacaaaggacactgtggactctgctgctaaggtgatagaagcttcgtaagagttagatagttttgtgccaacaggaagtttagaaggaaagacttcatacttctggcttaggctgtaagaaagtaattataattttgagttcttcctttttttcatcttcaacttctaccctgatgggactctataatcataattttaaaaaattgtattctgatgtggtagtgtctagttgccttccttataagctttctttttttcctttgatgcctttcacaccagtggttctcaacctttatcatgcataagaatcacttaggttctggttaaacatgtagtttcctagggtctgttccaaatctatgtaatcagaattctggaattgggtttaaggtctatattcttaaacaggtgcttcagtgcctctgatataggtggctcatggatcactgtttgaaaacactgccttactctctttacccatcttcattataacttacagattcttactaggcagcttcttgtgtgtgctgtgagaatatgagaccaacctgtagaaactggaatgatattaaatgaaccaagtttctagtttaactttttcacaaccactttttcttactgaaaaaccacttgtatcttacttcatttgttagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgtaagtaacattttcagtgctttccactagggatttgtcattaagactaccagtgctttaaaagaaagctcttgctcttttgtttgtgcagcaatcacaggcacactggcaatagctcttttgtgagttgtttcctcctgatatattaagaaccatcttcattgtattaatcagtgattagaggcaataggacatgcaaacaaccagagaagctatgaaaaaaaataagtaaatatttacataacttggaaaggtcactttttaaaataaaatatgtgactagagttttgggtaggtagactagacccactcaaatgtgtgactagaattttgggtgggtgactacagtgttcagagggtaggatcaccaaacagagttctcaagaaaaacttataatttgtattttagaaatggttttatcttctctcatcttgtctaattcaaaatcataaatatttgcatatatgtgaaatcttcaaatgagaaaatattataattattaaaacgaatttttaaaatttaagcatgtttttcttattttgacataggttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcagtaagttatattttcaggaataaaaagaaagagttgcttcatagtgtgccctataataggttttaaagttaatctttaggaaatacattatttcagtatgtattttctttaaataaacatcattctaaatagtagttcttaaaattttaaaatctgttgaacactatggaccctacccctagaaaaatgtggttatgtccatgtacacaagatcatacatacaattttgggagattcacaaactaaagttgagaagccctgctccacatagtgcttcatgtgtaatcaagattaaaatggtaagataccaggaaaactatttttaaaaaaccttgtttgcattacttttcccatttaaaaataaaatttaggaagtatacattaagaaaaaacattaaaattttttttatctgtgtcctttgttgccatttctactgaggtgtttaccttttacttacttgttatattctaaatcttttgttagagcctaaaaatatcaatagaatgcatatgtatgtgataaagatagtcactctttgtcatatatgttgcagggcttttgtagggtttttttttccattttgcacctaaattgcttatgttttctgtttcctagaatttttttcaaatttttttgtgtagtgaaatttcgtgttatttcattttgtttccacaactcagtgaaatttatatatatttttcattccactaaccagccatgggccttgagcaaatcactagtatttctagatctcagttattctgtagaattgggagaataatacactattgttttaaagaaagggagatgagccagctgatctcttgatccctctgagcattaggaaccttagaattgtgtagtattacattgtatattttattttttcagatggttgacattactactgaagaactgaaacagcagtttgatcaagaaataaaagtaatggcaaagtaagtcttaatctggcagtgcggtgtagtggaaagaaaaaagacaaggagtaaagaacctggttcactctagagtatgccatgaactagtgatgtttgcacatatatgaaattaaaataaagtgtttagattagagaaattgaaagtacttttggctccataattctatgattacatatactcatatgcctggagattaaatagcagtcatttttatttatttattttttttgagacagagtctcgctcttttgcccaagctggagtgcagtggcatgatctcggctcactgcaacctctgcctcccaggttcaagcgattctcctgcctcagcctcccgagtagctggacctacaggcgtgtgccaccatgcctggctaatttttttctgtatttttagtagagacggggtttcaccgtgttagccaggatagtctcgatctcctgaccttgtgatccacctgcctcagcctcccaaagagctgggattacaggcgtgaccacgcctggccgcagtcattattttaagtcacaacaaagttacgtgaaatttcactatcatgtccttcattatcatgttttccacttccagaattcatgagagatcaattgtagagatacttaaaaacaactatctatagagtaataggcccttatatataaagtagcatctatagagcaactagagtcatgttatctgtaaggatgcttagaaggcattgatcctgtgtgctggaaaattgttggacatcatcaggaaaagtaggagggacaaagtaggaaatgtattctaattattatagtgattaatagtgattgatatttgagtgtgtgcaacatgccagacattgtgctatgtactttatgtgcattgtctgtctaacccttacaactgttacaactgcccattttgtttgttaactgagatttagaaacattaaatagcttgtccaagatcacatagccagtaagtgttagagatgggattgaaatccagatctgtttgattgcggagcctgaactttagatctgaatcgtaatgggatttaccaaattatacccattaaacccactgctgtaaatcaccaatcatagttacctaacctcaagtaagaagaatagactagaattgatttatgcacggtaaaaatgatacatgctgaaaaaagatcaaactttttttttcaggatttgtcttcttcactcctacccctactctccaattctaaaagtaacttgttcacagtaggtcatctggaaaatacaggaaaacatttttaaaatatacaagcctatatgcatgcaggacttaatacgtaggtgatgggttgataggtgcagcaaaccactatggtacacgtttacctgtatgacaaacctgcacattctgtacatgtatcccggaacttaataatacaaaccatctctcaaatatatcactcagagataaccactgctaatatttttatatacttgcttcatgatgtgtgtgtagcattttcccatgtcactaaaaataatttgaaaacattttaaattattgtacaacagtctagcatatgtgaaaatcatattttatttaaccatagctaggtttgtttctaattttcagtattaaaaataaagcttctttaaagttctttgcacataaatctttaaatgcagttatacttactttatcatctagggtaaagtcctagaaaaagaattactaggtaggaatgcatgaactttttaaagactttctaaatacacattcaaatggcttttgagataagttactaccagcaatgtattacaatttcaaactttactggttccttaccttcatttaatatcattactttttttttttttttttttttttttgagacggaatctcgctctgttgcccaggctggaatgcagtggtgcgatcttggctcactgcaagctccgcctcccaggttcacgccattctcccgcctcagcctccagagtagctgggactacaggcgaccgtcaccatgcccggctaattttgtttttgtatttttagtagagacggggtttcaccacgttagccaggatggtttagatctgacgtcgtgatctgcctgcctcggctgggaatacaggcgtgagtcactgcgcccggcctattattacaattttttaataagtgccagtctctggatcttactagcagaatgaacttggccaagttttttaactttctattcgttaattttctcatctataaaatgggacaatagtacttacttaagttattgtgaggattaaataaaacagataaatcacttgccacactgcctcgtttatagtataaattcagcaaacgttaactactcatgtttaaaatgtgccagtttggtggaaaatgggacacttactgttttaatttgcacttcttcaaatatttatgagactagaagaaattgatataatgaactgctagaattgtggatcattttgaatgaacaaaatgaataagcacttaaataataaaacacttatcatgtgccagatacgtttctaggctgtcatgtttacatttgctcatttaattgtctcagcatccatattacatactgttttctgcatttagcagataaaggagctgaggctcagtaaggctgttaacttgcggtaggtcacatatccaggagggggcagaactagactttaaatttaggatgtataactctgagccctgttttctttcgtcttaccacagatgctgccactttattagattgtaggtctctttagttttattactctcaagtatataaagacactcaaattaggttataaataatccagtgtgattaaagatcaaaaacatgtaaattagatgtgattcaagatcatgtctgtaaatcagtgctttgagtgtgttagaaaattcttgacagtattagcataaaaattcaacggacttcttgaaatcttatttgtgccatcattgaaaattgggctaaagaaagtgagcatcagcctagtccttaaccaaacttatcacaagttccaaaaatctgaattatttagcttttactgtaaaatagaaagaggtttggccagctgtagtggctcacacctgtaatcccaatactttgggaggccaaagtggtaggagcacttgaggccagcagtttgagaccagtctgggaaacacagtgagacctcatctttacaaaaaaatttaaaaagtagctgagtgtggtgtacaccagtagtccaagctacttgggaggatgagttaggaggatcacttgagtccagatggtcgaggccgcagtgagctatgattacaccactgcactccagcctgggcaacagagttagaccctgtctcaaaaaaaagaaaaagaggttttacttctaatgttgattaatactggctgaaaagagaagtatttgcagaaaattataaacagttacaataaacatatataaacataaacatcaagttagaaataatatataacatactatttttttgctctttttttctattaaaactttgaataacttccaacctatagctgaatatatatttattataataattttgcatgaaaaattatttgtcacaggtgtcaacatgaaaacttagtagaactacttggtttctcaagtgatggagatgacctctgcttagtatatgtttacatgcctaatggttcattgctagacagactctcttgcttggtaagctatttgttcatcagattgtttggctttttgtttatatgctggaatattaatattcattttgttactggattatttaaaccaaattcactttcatatttttcctgctctatgaaaattatacagttgatatgtcaacaaattatacagttgatatgtcaacaactgggttgccattttattaggtggtaatcttaaatgtagaattcagttaagactatactaggaagatgcttttatatatttttatcttcaaataacaaatgtaaacacccatttgagcttatttagatattatttttaataacttaaaaatgtagtcctaaattattaatgctataacatcatcttcagttgttgcctagaaaaatattctgtgttatatattctctgtagattttttattattctttctcatttttaatttggtttatttctttataaggatggtactccaccactttcttggcacatgagatgcaagattgctcagggtgcagctaatggcatcaattttctacatgaaaatcatcatattcatagagatattaaaaggtaaatgctactgtttaaaagtttttggaaagctgtctttaaagaataatttgctgtcactctattcacgattcatatgcaggtcttaacctagagcatctggacttttttcccatcactccatgaaagctcttctcaataaggacatctataatctcctttattccaagcccagtgacctacttccagtactcatcctacttgaccttttttgtttgttttaatagtagtttattctgttcttcttgacacttttgccttatggaaattagttgttttcttagtttatggatcactattcttttctgaatcaccttcatcctccatgagtacttttcagttctctttctttcttgtgtatttatctagttaaatatttacctactataagtaacatattcatatatagagctcaacatcaatcaaataagcacaaaataattatagaatgttaatatgtacagttcacatatatattatatgtattattattatatagtatagtacataggattaatataaagaagggtttccaagaaagtgacatttaagcagagattcaaagaatgggcaggaaataagtagacacaatttgagggtaactgtagaatggatgatggggagaagaacattctaggcagaaggaactgcatttgtaagaccagtggtgagacagaatatgggagcatgatgagttacaagaaatgaaatatgctttgggagccaagataggaggatcatttgaggccaggagtagcagacctgactatgttccctgaacaacatagcaagacctcatctctacaaaaaaactagtcaaacgtggtattgcatgcctacagttccagacactagggcagctgaggagggaggaggcttgagcccaggagttcaaggttgaagtgagctatgatcgtgccagtgctccccagcctgggtaataaagtaagactctgtctaaaaaaaaatgaagtaaatgcagtatgactgagatgcagaaagttatagggtggtggattggagataaaactacagagaagtgtaggaagctaagtcctataggacttaatagatcaaggtaaggcttttagttttatcacaagtgtaatgagatgccgttgaaaattttaagtaggaatatggcatcatatttaagttttgcaaagatgattttaactctagtgtagagaacagtttgtaagaagaggcagttagtaggctatcataggtggcagttcataagaagagaggggagcagattagaaagattaaaatggcaaaacttgttgataccttggctatgcaggggttcaggaagagcgaagtatcaggaatgactcctggaataatggcatccagacttgcattctggaatgattatggcatgattcacttatgtagaaaggactgaaaaaagacttggttaggttggggttagagagatggttagaaaatgtgaattctcttttgtacatgttgtgtttggggtgcttttaagatgtagtagtagagatggtagacagtgtgatatacagatttggagctggaggtctgagctgaagatataaatgtgtattacttgcatacaggtgataattgaagtgactgtattcacttgaggggagatgtagattaagaaaaggtcacaagattaagtcttggggaaccctaagacttaatggccaaatagaagagatgatcacaaaaaggaatctaaggaagtacacatacagagaagggtaagatgaaaacctggagagtgtggagtccctgaaaacgaggaaagaaagtgtttcccaagagggagtagtcaaaaagagtcaagggctttaatcattggattagcatcaccatggtctttggtgactttatggaaacccatttccaggtagtagttggtttagaaatcacattgtagttgagagagtgagagctagagaactgagataggagtatagacaagtcttttaagacattttactagtgaaggggacagctagaaatagataagtcattcaggaaactttttttaagctggcagagattaagctgtgcttatgtgcctataggaaggatccagattaaaagggagaggatagtatggaagagagaaatgagatgatgtgttcagtagggttactgagaatgtagaaagcagctcaagcagaggaactgaccctagatgagaaaagaaacgccatctcctatccttcatggattggtactttcttgtgttcttatatcattgtctcttttctccctgtatgttctttttttttttttttttgagacaagtttcactcttgttgcccaggctggagtgcgatggcgcggtcttggctcactgcaaccgtcgcctcccgggttcaagagattctcgagcctcagcctcctgagtagcttggattacaggcatccaccaccacgctctgctaattttgtatttttagtagagatggggtttctccatgttgatcaggttggtcttgaactcccgacctcaggtgatccgcccgccttggcctcccaaagtgctgggattacaggcattagccacccgcctggcctctctctgtatgtttttgctgagtgatattatgttaattttaactgctacttatatgtgagtgtcttttgaatctgtattattagcttccaatcctggatttttagtatccccgtaccaaaaacacttcatctgggtatcccacagtagcctttaagtcagaacattagaaatcaaactcatcagctcttcccaacctaaagtcttcccacatttcctttctgatccagtgaagtcactgttcattctgtctctcaaactgaacacgttctcattctctatatcatgctaattacaaaattctgttgtgtgagcctcaaaattttcactttccatttatcccatgttatgaccatttaaaccctcattatctcccatttgctttgttacaaaccttcgtagtcaacctaaatccagcctatcagttctcatctattcactaccacactactaggtcatggtcctaaaagttaagtctaataacatcagtttcctactgtgaaaactttagctggtatcctgttgctcacaggataaaatgcaaattatctccatgtttcttggacactcgttccttgaagttgaccatgtataccatatcatgtttttgtcactttgtacctgttactccatttgcctggagtgcctttctttccctcatataactattaacttctaataatccttcaatactaagcacacttttcaccctctgtttgaaatttttcctactttttccaggcacatggttgttctctcagcattttgtacctaatattaccattgttttaaaaaattatttatgcctttgtcacagacaagattttaagactccgccatgcccagcagtgagcttaaatactacacaacatagggagttctcaataagattgtgttgaattaaagtatgaaagcacataatgaattaattgagatattttggccatatttttttctcttcaaaagccagatagtacagaacaaaagaataaagaaattcataattgagatactttggttggaaatttgttttgaaatgaattgatacatactaagaaaggaattaataaaggtgccttggaagactttgtagtaatttaccctataataaatgatttgtggaataatgaaaatatctcttactaatgtagacagttttatttcatttttattctcctaaatgttttcctcaagaaacataaaaaaagaggacagttgcttctctttagctataatctgaattctaggtttatttctataaactttaggcttttatgatgcatactataaaacgttacactctgtaaatatgtatgtacatatgcatgtatgcatatacatatatacatgcatacatacgtacatctagctaaggaactgtttgacttttttggggtgggaaaaacatttttttcttcaaactttacatttttttcagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggtaagttccgtatacataattattaaaaataatcattctgctataattgtgaaaatgaagagaatattatttaatacacccatcttgtttatctctcttatgtaacaatataagtttttcacattaacctctacttataccagaaagtttataaaaacttcttccaatgtgtaaaacttttgagttgatttttgaaatgactacaagaaatgattttcttgccatctgtctttatgaattagcatgacacctaatgcattaaatgaatcatgtcatacagtatatactttagtctcacattttttgacatttactaatctacctctctattcccaataacttttaagatagagcaagagataggtgtgggtggttgaagaagccgggggctttttcttcattttattttttcatacgtgtttcatatatggaaatttaacttcatagcactgaaaataaggcatagggctatagaatatgcctaatgtttagaaaataatattctcctaagagccagagtaaattattcttgtgaagaatccccaagaggcaggaaaaggattgggagtccttagaacatatgttgagtggggctgactctttagtaagttgccaatagaaaagagctgcttatggtcatgttggggtccaagatgtccctgaaggagggatggtgagaaatgcccaaagctcatgttctttccactttaatatctaaaagacatagctttgtatagaatgattaatcaaattttgtaagcaagattcatattcattctagtttttgtcttgagtattatatatataatttattaatatcatgtataatatatatattttttagagagacaaggtctcactcagtcacccagactgaagtgcagtggtggaattatggctcgctgtagcctcaacctcccaggttctagtgatcctctcacttcagcctcccaagtagctgggactacaggtgtgtgccaccacacccagccaatgtttttttaaaattttttgtagagacagggtctcactgttgcccaggctggtcgtgaagtccggggctcaagttatcctcccacatctgtctcccaaagtgctgggattacaggcgttagccactgtgcccagcctatcttgtgtattatattaatgattttttttgtcttcataggttttactagaaataataactggacttccagctgtggatgaacaccgtgaacctcagttattggtaaatgaaatattcattttcctcaatccttttttctctgcttttgtagtctaaatttatatggataaatttgacatctaaaaataacattttctattggcaatctttccattggctattacacgacagcatatggaaaaagcattaaatattttcattctcagctctcccatgaagtatttgtgaagcctagaaaagtcacttatatattctttgttctgatttctttgtgggtaaaatgagaatagaactaaatgatttctgaggtcctctttagcttatgtttattttgtgtcacttttggggtggctactgttaataacagtgtttccagcattttcagaggggggaaaaaaaaggcttccattcaaatttctttcagaataaaattgctagtaaaagttatcacttatttctatcatggggtattttatttacaaagttacaataaaaaacataccaaatttgctattgttaggaaaaattcatatcatgtttttcctttgctctcacaccacaacaacaatcaacacagaagatttctgtgaccaaatgcgactgggaagggtttctccccaccaacaagcaggcaatctactttgcagcggaagtcagctggatctcctccaatttaattctgacactacattcctggacatagcatcagagtcagatcccacaggttaagagctcagtccccaagactgccatcccaccagacaccagttgtaagtttaggcctccagaacttctgaccaactgccttcaagttggagttcctatgacctcctctgtgggtatggagggctcaagattgaacccagattgattcactaagttgcagcatatactttacctaagttttccatcgttttgcctaagactttttccttcaaaatatataaaagcctcaaaactttggcttgagtaagaatgaaatgcagaaaaacataagctgtatctcagtcacaagttttgcatttcatcatataatagtgaaaatcataaatctttggagaaggttttactctttcacccattcttaaggtttgactgtgatgtgactctaaagtaataagattttcatacaagcacagtttttaaaaaagtgatcatctgaagaaccgttatgtcactagattctgccgttgtcaaacattttcagaatttatctttgaaagtggttttgaagagtttacatcctacctctcatgaatagtttttttcatctgtattagcttcctaggactgttataaaaatataccaaaaactgtgtgacttaaagcaacagaaatttatttgctcatagttctggaggccagagtctgaaatcaaggtatgggcaagactatgctctctctggagactccagagagaatcttgccttgctcattggatgtagggcttacctccaggattagccataatctggaatgatctcatctcaggatacttaattacacctaaaagggcccttcttttcctaataagatcacattcacaggttccaggaattatgacatagacatgttttgggggaccatgattcacccaactccacgatcttattcctacacttctctccctgttaatttttttttatcatggcctgctccctattttttcccctccttttttctctttgattcaacaaccttagtacccatagagaaatttgttgggtacagggaggaggagtcagggtccaaaagttggaattgcgctattagaagcacatcaagaagcagaccaccctgtgctgcccacctagtaaatgctgctaatgggaacatataagcaattagctcataacatagatataaaaattggaaggcaaatgggtggaagtatctaggaggtataaataattaaatatacatttgtatatatatatgtgtgtatatatatatatttatatatatatatatacacatacccagccatgtgttgcctaatgacaggaatacattccgagaaatgtgttgttaggcagtttcattgtgtgaacctcatagagtgtacttacacaaacctagatgatatgacctacgacatacctgggctatatggtattgctcctaggctacaaacgtatgctatacagcataatactctcctgaatactgtaagcaattgtaacacactggtaagtgtttgtgtatgtaaacataaaagaggtacagtaaaaatacggtattataattttatgggaccaccatctatatgtgatctgtcattgaccaattgaccaaaatgtcattttgtggtggatggctgtacttatttacataggatttgtcctgtatgtcttcaatttttttttttttttttgagacagagtctcgctgtgtcacctaggctggagtggcgtgatctcggctcagtgcaacctctgcctcctgggttcaaacgattctcctgccagccttccaagtagctaagattacaggcatgcaccaccatgcctggctaattttttgtatttttagtagaaacagggtttcaccatgttgcccaggctgggtcttcaattcttaataaggttttaagataagatagtaaaatgagagcacatgttattacaaagtagattaatttaaataattaaaatatatattctattttctttcactatgatttgaagctcttaaagttttaacactcattttaaagctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggtatgcattttttatacttatttaaaaagtgaaaggggtggggttcatcatattttccagagtgtatattttaaagcaactgtataatgtggttcttttgtttttttctttctttttaaaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaagtttgtggtaatttattattcagtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctggagtgcagtggcacgatctcggctcactgcaagctctgcctcccaggttcacgccattcccctgcctcagcctccccagtagctgggactacaggtgcccgccaccatgcccagctaattttttttgtatttttagtagagatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgtt

SEQ ID NO: 1811 - DNA, 30600 bp, Homo sapiens; identical to SEQ ID NO: 1810
  source 1..30600: mol_type = genomic DNA

SEQ ID NO: 1812 - DNA, 30600 bp, Homo sapiens; identical to SEQ ID NO: 1810
  source 1..30600: mol_type = genomic DNA

SEQ ID NO: 1813 - DNA, 30600 bp, Homo sapiens; identical to SEQ ID NO: 1810
  source 1..30600: mol_type = genomic DNA

SEQ ID NO: 1814 - DNA, 30600 bp, Homo sapiens; identical to SEQ ID NO: 1810
  source 1..30600: mol_type = genomic DNA

SEQ ID NO: 1815 - DNA, 6307 bp, Homo sapiens
  source 1..6307: mol_type = genomic DNA
tgatcatagcaggaaccagtttattggttgaggtggtggggaacaggggggttggaggcacaccatgaggagcgagggctcagctctccccagggccctggaaatccatgccctccaccaagtcctgcaggtaggccttgtactggtcggaggtgagggagagtgggtggctgttggaaatgtgcaggtccacagtattctccagggaggaggcaccccctacccgggccatttctaccaaggccctgaggcacgtgggcacaacctgcaggggaagtggggacaggagtcagggaaaacacccagccactgtccaccaaggtaggagtcagggcttggaggactacaactccctgcagcccctgctgtaacctaggatgaaccataggcctagggctgctgggagttgtagttttacacacacacacacacacacacacacacacacacacacacacaccccctgctgtaactgaaccataggcctagggctgctgggagttgtagttttacacacacacacaaacacacacacacacacacgtcagggctgagcagtctgtgatcttgactcctgggagccacagccatggcctcacaatggcagctaaaacttgagtccaccagcttctacatggtttagagcaggggtccccaacccccctacggcttgttagggaccaggttgcacagcaggatgtgagcagcgggtgggggaatattactgcctgagctctgccttctgtgagatcagcggcagcattagattctcagaggagcacaaactctatcgaactgcgcacgtgagggatcggctgctccttaagagaatctaatgcctgatgatctgcagtggagcagtttcatcccgaaaccacacctccctgtccgtggaaatattatcttccatgagactggtccctggtgccaaatagtttgggggccactggtttagagagttcaaaacaggttctgcaggtgaggccatgggaaggagctcccggggatgaaaaactggttattgcagagatcttggaagttgcagttttttagagggccctctgggagttggagttcctgggagcaacctcttccctctgtaaggccacccctttcagccccagggactcaggtctgcaggcaccttgaccatcacgagcctcttggtccacggctggtcctggggccatgactcccccacacagaaccagagggcatagcgtggtgagcgtccgcttccttccgtgaaggtaatcagatctgggggcccaggagcctagtcagggatgagaagaggaccctctacccacccttccccgtaaacttgaatgataacccccaccacctcccctgacctaaggccctctgctgcctcgaccaggggactgcttgtttggggaaagtcccctccttccctccctccctccctcccatcagggtggggttgttggaaggccacacccccaagcccccaagcctcagcattcataacaggcccagagtagggggcccatgctcccaaggatgctcagtgaatctggagaagctggttggcattcagtcctgtctgaggctgcattgtccaattgcagccattagtcatgtaaggttatttcagtttaaattgtaaccaattaaaacgaatcacgtcctggttgcactcgcctcacctgagtgcttggcccctgtggctagtggctgctgcaccggacagtgcaggtgactgtcatttccatcatggcagaaagtgccactgcacagcgaaaccctaagggatgtagctttcctgctattggtctgttcaccatcattagttacgatgatgatgacagtggcagctaattccctgagcaggctctgtgtactgggcctgtgtctcaccccagcgctggcaggcaggtagagagaggagaccatccttggattccacgggctcagggcaaagtcctttgcctcggttatacagcgggccaagggcagccagcgtctgaattcagtcctaatcatgagttcttttttttttgttgttcgagatggagtcttactctgtcaccaggctagagtgcagtggtgcgatctcagctcactgcaatctccgcctcctgggttcaagcaattctcctgcctcagcctcccgagtagctgggattacaggcacgtgccaccacgcccgactatttttttgtatctttagtagagatggggtttcactatgttgaccaggctggtctcgaactcctgaacttgtcatctgcccacctcagcctcccaaagtgctgggactacaggcgtgagccaccgtgcccggccaatcctgagttgttaaccactgtgcaggctgctttgtactggccaggtcgaagcccctgtctcactcacctacaatgaagggccccaggtcaaacacgcctccttccttgtccttggggacctcgccatcaggcccatgcccgctgttggggagcagctcctcgctcactgcccagtatgtgtggcagtgccccagccgctgggcccagagccactgcccggcccgccagagagccagtcccccacccaggcagctcagcacatgcctcacgtagctcatcactcccctgtctgtcagggacatgccagggtctggcagtgtgactggccatccaggcagcgtcctgtctcccacttcggaccccaccagccgcaggccctccgggcaggagatggtctgctggaagacttggcggccccggtagaaggctgtcacctcgaactcccactctgagcagcggcagcagcggcatgaaggggagaggggttgagaatcaggggctgccgcccagacctcagccctcccagcctgcagctgacactcaccttcccccggcaccaacagccgcttcagtgggttctcagagggccccaggtttgggaagggagtgggattgtccaagctggggctccgcaggggctgagggcagggctcaggggctacagccaggcttgggggtcccggatctgggagtggggccaacaccatgttacccagtaactcatccagaatgtcttcctggagggaaacaaaaaaagagaatcaggcatttccatatccttttctggagacttcatatggaccaggtctgttctcagcaacgcagggaggtcaggcttgagctctgccttcaaggggcttccagcctggggacagagccagccatggcatcaacagccaaacaaacactaatgaacgccaggtgctaccattccaacccaaggatctggctctatgcaggtaagacctgggcaaagcaggctgggtagaatttcagaggggatgctcccccagcttgggcctcagcaggatcaaggtgagggagtttttcagttcccaagaggctgacagccccctgcgaatcgaaatccatgaaatcccgggaaggtgtgctcgggccttgaatgctgggtgaagacttggaattttctcctgaggagaccggggcagggacagacagggtcagcactggctcaggtgaggggcaggctggaggcaggggagtggggggatcgtctagagggagaggacaaggcccatggagacaggtcggagactgaggggcatgaaagttgggcacattctcacctgggtatcagaagtactgcctccaccattggtgtccggagaggtgtctggctgggaaaagtccccaactcctgttgagaaaagtggtgaggggagtaggagtgccaggaacccttggggccccagcctcccacacgaaccccaagctggcagacctgagttcacaaactcgtagattttatgtgggtcgtgagggtccttgctccggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgctcctggggccctaaccctgtctcccgagtcctaacaccaccctctttccctggcaagttctaactctgcaaggtccatccccaaatccccccgtcccacctacctccatcccccacctctagttttcaaaaggctttttttctttttgagatggagtttcactcctgtcacccaggctggaatgcaatggtgcaatctcagctcactgcaacttccgcctccccggttcaagcgattctcctgtctcagcctcctgagtagctgggattacaggtgggcaccactacacctggctaatttttgtatttttagtagagatggggtttcaccatgttggccaggctggtcttgaactcctgacctcaggtgatccgtcctcctcggcctcccaaagtgctgggattacaggcatgagctactgtgctcggcctcttcaaaagcctttgaaacctctttggtttttgttttgtttcgcttttgtttttaaagagatggagcctatgttgcccaagctggcctcaaactcctgggctcaagcgatcctcccgccttggccttgcaaagtgctaggattacaggtgtgaaccaccgcccccggcccaaaaaccttttctttctaagccaggcttccaagtccaacttggtgtctaatcccgtgcaccacctgccccgcgacaccctctgtgataaccccgcccctcacactgtttaccacctctggcatatactaattcggtagttaggaacctcagatttggggctccaggcctcacctctgatgtttcaagaaccatcccccagtatctatcctacaaccaagagccccggcctctagaaagccccaaacccccaggatgcatttcctttgcgtactaaccggctttcccggttttattcccgtaaccctgcagctccaaccctgcttgcgccccaccatcagtcagcggatccggctagccccgcccctcccgttctagccccacccaccagcgttggcacgagcccgcccctcgcgcgccacctccgccttctcagccgggcccactaggagtcctttccgcccagcgcgcagctccgggtttccagcgtcccaggtcgtcgcacgcacctggaagattccgaaatcctcctgctgtgcatcctgccgtaggccgtgcttccaagggatgcggaagcgcgtgcggctcttgttcacccaggccacgccctccagttgccccaggtccagctgcgacaccagccagggcaggatccgtggctttggggttcccatggtccggcctgcgcgtatagggcatttcctgggcgcgaccggcctcccccggacccacctggcctggagtttccgcacccagacctccttctcacgggccacggcacaggtccttcacccatattttcgggggtacaaacaggaaacctcctcttcccatcctcccatcctcccgagaggctctctaatcagctagggttccttcccatatccatggcacatccttccccagcgtcttcagtgcagaccctccactccctcaattccgccagtatagacctcctccctcccccacatcatcgaaagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttcc

SEQ ID NO: 1816 - DNA, 6307 bp, Homo sapiens; identical to SEQ ID NO: 1815
  source 1..6307: mol_type = genomic DNA

SEQ ID NO: 1817 - DNA, 6307 bp, Homo sapiens; identical to SEQ ID NO: 1815
  source 1..6307: mol_type = genomic DNA

SEQ ID NO: 1818 - DNA, 6307 bp, Homo sapiens; identical to SEQ ID NO: 1815
  source 1..6307: mol_type = genomic DNA

SEQ ID NO: 1819 - DNA, 6307 bp, Homo sapiens; identical to SEQ ID NO: 1815
  source 1..6307: mol_type = genomic DNA

SEQ ID NO: 1820 - DNA, 6307 bp, Homo sapiens; identical to SEQ ID NO: 1815
  source 1..6307: mol_type = genomic DNA

SEQ ID NO: 1821 - DNA, 6307 bp, Homo sapiens; identical to SEQ ID NO: 1815
  source 1..6307: mol_type = genomic DNA

SEQ ID NO: 1822 - DNA, 6307 bp, Homo sapiens; identical to SEQ ID NO: 1815
  source 1..6307: mol_type = genomic DNA

SEQ ID NO: 1823 - DNA, 6307 bp, Homo sapiens; identical to SEQ ID NO: 1815
  source 1..6307: mol_type = genomic DNA

SEQ ID NO: 1824 - DNA, 3445 bp, Homo sapiens
  source 1..3445: mol_type = genomic DNA
tgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtctgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaaggacccctggagacagccccccaggcaagggcctcactgaccttggaagaagactctgaagtcgaagatgggggtgtcacagttccgaggcagcaggcaggctggggtggaggggctggcggagcctgggggtccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctctgtgtggagaccaagctgtgagtgacgggggtgggcggggacaggctgtgagtgacgggggtgggcggggacaggatgtgagtgacgggggtgggcggggacaggatgtgagtgatgggtgggcggggacaagccgtgagtgacgggggtgggcggggacaggctgccccttcctgggatgcactcaccttgcaccgcggtgcaggcgcttggggagggtgacaggtacggctctgcctggtgcggggactctggggccgcggcctcgcctgcatccggaagggaatcctgtgctggcacctcatccctagcctctccctgtgccccaggcctcccaacccctacccctctcacctgtcgttagtgccgcgggctggggcccggggctgggggtcgtctctactgcccacccgtacagctccccagcagggagccctgggcctgaggaggggaggacagtgggaacggtggtcccctcctaattctccagctccccaatccccagcccccttctaaagtgtccgtccaggtgcactggcccctcccgcgctccccccctccccgggcacgcccacacctccagcacaggccccagtcaggggaagcccttcttgtccctctccaggagccttggttgggactggatctgccccccatgacgctgtcagcagatggtctgccaggcagctctgttgcactgcctggagcaggaggtcccccttgtcaccagctggggcagggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttaggctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatcccgcagcatcacgaagcgacgcgtgctgcgcagtgcgcagcggaagttggttttccagccggcgcgctccgcagtctcagcctcggggggcgggccacctcccctgctgctaggcggccacctgccgcgggccacagcccaggcctgaagagggggacagaacacgtgtgccgggcccgcggggtcctaggcgggctctcccacccggggcggggcggggctggggtccccaccttgaagatgcgcgcgtcggcctcgctcaggtccttgcgcgcgaagtgcttccagggcacgcggaaacaggtgcgggcctcgtccagccactgcagcccctcatagcagccgctgctgatctctccaaggagccactctccgaacagcacgcgtggggctgccctgcgggtgcccggccgcggagagtcagggccggctgcagggcgctcggggactggcatctggagagggtgggccgggctcttacctctcaggagccaaggccattgctccttctgcaggggcagttaggtggcggtcaggtgttataacaggggaggtaagggctcctgtcgcagcagacgccaggccgcggccacaggtcgtgtggccaggtgtcacaggtgtccacaggtgtggactgagggcttgtagccaccgacgctgcctcggtatggatctcttggcagagggggctacaggtgtgactgcaggtgtggccggcgcgcacacatgaagtcacaggtgttgaaccagtgtccaggcctggcgggaaggcgcaggccggaccctgcggagacgggaaaggcgacgtcaggggcgggtcaggctcccgggaaagcgaaacctaaacagtggcgcttcgcaccctcctcgatcccaccccgtccggttctcagctccgcggaaccccgcctccgcctccgcctccctccccgcccgaccctcatctctcaggctcccccagctcttggctctacccctccggggtcacggagcccccacggaggctctcgctcccggcctgcaccgcgtgggtctggggtccccagtacctgggtgccagagccgccgggacgggaagtttcgtctcgcggggaagcggagggccggcgcttttatggtggccaggcgggagtttc

SEQ ID NO: 1825 - DNA, 3445 bp, Homo sapiens; identical to SEQ ID NO: 1824
  source 1..3445: mol_type = genomic DNA

SEQ ID NO: 1826 - DNA, 3174 bp, Homo sapiens
  source 1..3174: mol_type = genomic DNA
tgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtctgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaaggacccctggagacagccccccaggcaagggcctcactgaccttggaagaagactctgaagtcgaagatgggggtgtcacagttccgaggcagcaggcaggctggggtggaggggctggcggagcctgggggtccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctctgtgtggagaccaagctgtgagtgacgggggtgggcggggacaggctgtgagtgacgggggtgggcggggacaggatgtgagtgacgggggtgggcggggacaggatgtgagtgatgggtgggcggggacaagccgtgagtgacgggggtgggcggggacaggctgccccttcctgggatgcactcaccttgcaccgcggtgcaggcgcttggggagggtgacaggtacggctctgcctggtgcggggactctggggccgcggcctcgcctgcatccggaagggaatcctgtgctggcacctcatccctagcctctccctgtgccccaggcctcccaacccctacccctctcacctgtcgttagtgccgcgggctggggcccggggctgggggtcgtctctactgcccacccgtacagctccccagcagggagccctgggcctgaggaggggaggacagtgggaacggtggtcccctcctaattctccagctccccaatccccagcccccttctaaagtgtccgtccaggtgcactggcccctcccgcgctccccccctccccgggcacgcccacacctccagcacaggccccagtcaggggaagcccttcttgtccctctccaggagccttggttgggactggatctgccccccatgacgctgtcagcagatggtctgccaggcagctctgttgcactgcctggagcaggaggtcccccttgtcaccagctggggcagggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttaggctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatcccgcagcatcacgaagcgacgcgtgctgcgcagtgcgcagcggaagttggttttccagccggcgcgctccgcagtctcagcctcggggggcgggccacctcccctgctgctaggcggccacctgccgcgggccacagcccaggcctgaagagggggacagaacacgtgtgccgggcccgcggggtcctaggcgggctctcccacccggggcggggcggggctggggtccccaccttgaagatgcgcgcgtcggcctcgctcaggtccttgcgcgcgaagtgcttccagggcacgcggaaacaggtgcgggcctcgtccagccactgcagcccctcatagcagccgctgctgatctctccaaggagccactctccgaacagcacgcgtggggctgccctgcgggtgcccggccgcggagagtcagggccggctgcagggcgctcggggactggcatctggagagggtgggccgggctcttacctctcaggagccaaggccattgctccttctgcaggggcagttaggtggcggtcaggtgttataacaggggaggtaagggctcctgtcgcagcagacgccaggccgcggccacaggtcgtgtggccaggtgtcacaggtgtccacaggtgtggactgagggcttgtagccaccgacgctgcctcggtatggatctcttggcagagggggctacaggtgtgactgcaggtgtggccggcgcgcacacatgaagtcacaggtgttgaaccagtgtccaggcctggcgggaaggcgcaggccggaccctgcggagacgggaaaggcgacgtcaggggcgggtcaggctcccgggaaagcgaaacctaaacagtggcgcttcgcaccct

SEQ ID NO: 1827 - DNA, 23438 bp, Homo sapiens
  source 1..23438: mol_type = genomic DNA
agcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttccaaagattggtagatagatgcctttttaaaaatctcatttttctttaaatctggtttacatggaaaacgttaggagagctcatataatgaacggcaatagcaaccccctatcttgaaacgcgctctatcatcccactgaaattctaccacgtggaataatgcttggagggtcagagttgtggaactgcccaataaccagtcgttactgagggttagtttgtgaaggaggggacagactgcttctaaaattctgtttaatgacagtcaattaagatttctgagtctggcttgagggcctttgcttccatcacagcccagtcgtccttggcaagagagtctgtatatgggccacagctcacaaaagcattgtttgaaaaaatttattgaaagaacattgtttgtaaaatgagtcccaatacataggacagactttcctaaggtgagatgtgttacttacccagagctgtgaaaggctttacggatggaaactagagactgaattttccagaattttaagaagtctccccaaccaatggccccccactttctttttttaaaccaaaggtaagaactggtagttaaaatgacagttcaaagcttgtccttttgggttacggcagcttcctctatgaaaagatttgggagtgattcagtcacttgaggaaggttggtgccagagagagaaatggctttggtgctttctggtctagtgatgcgggtatgctaggccagagcgagtgccctgggccctccgaggcgggggagagggtggggtctgctgctgccagctcaggtgtgacctgtaatctggattaggtgggcccagggcaacctcttatcacgtccctcctggaaagcctgactgctgtatacatttctagggctgcagatagggcttggccaatagattacctcaaaatcaagaagaggaagttataaacatgtgattagacttattaatttttcctggctgggcatttggtggaattcgtttgttaatgtttaataaatcattatggatcataactgtagtagaatctcaggcttttgatgttacttagaatcttggaggagaccacgaaggacacacagacgtggctgcacatgtgcagagatcttgtaacgtaactatggcttttctctgcaccatgtgtgaaataagctgccgctggcgttggggcgccggcctgggttccaacacagtccgctggctgcctcggtatttgccgtgcctctctgggcctcagtttttcctctcttaaataaagaggggactggattagatgatttctaaagtattttccagctttcagatgctatgacttactcttctctttttccttttaaaatttctttttcctgtaaatcaccaagatagttgtcctgaacagtttagatgttatgaatccattaggaatcctgataagaaagtgttgaccctctttctagaaaaatgcgtgtactaacaaaattttgcttttggttgcaggaggctcaggaactgtggattctagtttaagaaacttgtagcaaggaaatcaggggagttgaaagtctcagaagccaacccctatgttgtgttctggccacctctgtgcagctcattcctcaatctaggagaaatttttctaccttgccccaggaaagagctgctaacttgttttcggggagtgtgggggggtctttggtattggtgttccatttctcttctcaggtaccctctcccaagtctgtcccttctttatgataaacacagtggcctgctttagaattctgggtctcttgagatacagcctctcaacttacaggtgaggaagcctcagggagaggttcaagtgacgtcacaaggtctggttagagaaaagcctttgccagagttcagagttttcaaaccaaggtctaatttgggtgggcgcagtggctcacacctgtaatcacagcactttaggaggctgatgtgggaggatcacttgaggccgagagttcaagaccagactgggcaacatagcgagatcctgtctctaaaatgtatatctgggtgtggtggcatatgtctgtagttccaggtactcaaggggctgaggcaggaagatcgcttaagcccaggagttccaggctgccgcgagctatgatggcaccactgcactcctgcctgggtgacagagcaagaccctgtctctaaagaaaaaaaaattgaactcatccccttttaaatccataaacgcacaactgaggttgttggatggggaatttaagaaatcccacctcctcctccctgggacctggccctgtttcccgtctcatggccacctgcagggtggctgaagtttccagaatgcgtacttcttgtgaaggttctgattgatattttgctttctggaccagtgtggctctaccatattttgggatgttatgtcttgttactgctgattgtttcaaactcgtttgcccaaagaggtcacattttaatcagaagaacaaaaatgctatttttttttttttttgggtgggcgtctatccagctgtcttggggatttccagcactgttcttggaaatgttggctctaagtcgataggtcatgctagttctctctctctttctctgtgctgttggggaagctgtctgcttgggtgagagtgttcttccaaaggatgtctttgggtgccctgggatggttaggtccctagagtgggacatgttctggaagaggagcccagtgaactttgccctgttcggtagctgcagtttatttcctcactcttgtccctatctttcagttggtcgtaggagttgcccaggaaggaagtttggataataataatgacatctggcatgtaaggtccaggccctgtctcagttgctttccgtgtagcatctgaattctcttacaaccagtacaggtagtgttttgttagctgcatctgggactgggtagctgatgccctgagtttaaatgctgatccagcgtctcccagctgagcggtggcgggacttgaatgagatcgcggttctgtctcattctcaaactgctgctcttatcactgtgaaggaacagctatttagatgggctggcctgagggcctcctctttcccagacggcacggacgcagtattctatcagggaatgtggggccagctgggcatctggtagcccagttggttcttcggataatgggctgctcagtgaaggaacctggtgctgtaaaagtgattccccctctccttccagtcttgggctaaaactggagctgttcactgtggttgtatctgcctgaaaggaaagggcagatgaaagctggaaggagcacagccagcacagtgggaggggcctgcagggggctgctggtggctgcaggtttcccacggagctttcagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggtaaagagcccagctcccttccccactgtgggcacagtgtctcctttccctcatggactagtggagatgttgagtgacatctttctcatttacttaaaaattaatccagttttttaaaagcaaacattggttcaggagtgctgaatgtgtctcagacatgtacatgagctgatttcacatcttttgaattacggagtcacttttgtggtcgcttgtattctgatgaggagatcgaaggctcttttcttctcttttctgctgcttccttttcctgatgagccaagtgggagaaaatacttcgagaccttcacgctaagacctttccccacgggcttccattagaggcgatgcatataccagggaaggtttcagtccttgttctttcaaagctgatacttctgcctggcattgtagggccagctcaggagggtgagatgccatctgtcattcctttgggggctgggccgtgtggggggttgtgaacctgcagcagatgtctaaaaatagtctcacctcccttgagagtaatcggttccccatgcgtggagagacgtgatggagggtttgttctgtgccaggcctggcccacggcttgttttctgctcacatgatcctgtgtggtagatgctgttcccaccctcattctatagaggcactgagaggagaagtgacttgttgaggtctcacagctcttgtatgacggagccagcattcagatgcaagatggcccaactgtgaacccttggtcctaactccagaatagctgatcaacagagatttcttgccattacacctagattcagacagaggaaccaggaattagggcagcccagctctgcagaccagctgggctatcgaatcccttgtgggtcatcagagtcctgtgtgggcatctctaaggctccagatgtccaggtttcacctctgggagattcggagcccaaggtcaaggtcaagctagacttccacgtttgccagtgtggacactacacgtagtctgagtcctagcccaggttataagccattgccatgtgtgcttattctcttgcatttgggggccagagatggggaggggagagtgagtgtgggagaggggtgaaaggggctgagttgttgggggccagaatcagacctgagaccacaaacaaggtgtggagggggtcaaggctgtaggagcccatgacagtgctggactcccagccacagatgactgtcccctgacaccagagaacaaaaatgacaaaagatcacaccttaaccccagagtggaccataaataggtcaaaggtagcttaagatgcattttggtcctgcacgtctctgcctgaccgatgtttgcagtggggctgtgcgtttcagtaattctgttaaatctgcaatttgaggttgctgatcttcttgagaatctgatgcccattactgaccacgccaaggaatatggggacaagggaacgctttgcactcactttcgaggggtcccttggtgcccccacacgttccagattctttctgatcaaggaccccaggtcagggagcctcagcaccaagaagttttgtgatgccactgcctgcctcctcacccttagtgccattgtggatttctctcttgtttgattgcagatcttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggccaggagggagacgcgggtgcccactggagcagggaggccatcgggagggccaccagtgccggtggagacatggcgccagcaagagcccatcatgtgcttccctgagctatgcttcttcccatccatcctctgagaggcctgtctctgtgacgttggccggatagatctttggctgttggatgaagtcaacctcggtcaggtagagccatcttagggattttccggttatgtagacacttgtttctttcaactgttcaaagaaaacctttcaacaatttaggagttaagaaagaaatttatgagtttggtttcttccgtaataagtggatggtaaaaggggccacttataccagaaaatccctcattgtctgcaggcatcatcctgaggccggcctcatggtatagatcacagaagagaaattgaaaaaacattgagctcattttgtaccgaccctgagtacactgatgaggccctgatagcaactcatttaatttttaaaaagtactttaccttcttgacatgacgacaaggggggaaaatctagttaagtgaggattatgattcatggttattccaggcatcgtaacagtcctgaatgagttaaagctcacttagtagcacagatatttctcattcagcaggccttgaagggaaaaatagcatttaattaaaaaaatgcaacatgaaacaatcatattaaattaggaagacctcctggtcttagttcagtgctgtcagcctgagttgtgcgtcaacaggagaaataagttatggtggaggctgaatgagccatagtgactgttgctggcggcaggggtgggggggccctgaaatcactctcatgtctagtttttgctctagctcaagaaggatctcgagagatcatcaagctaagttgaccttttaatgctggccagagaggctgggagagggccaggtgcctgctgtgtcacagagttcagggcaggcggcaagccaggtacccgatggtggccctggatgcttcctggccgtgggccctgctgtgatggatgatgtggcctggacttgctcgtggggtgagtgtgagcttggcgtgaacgagtgagtatggcagtgccttgcaggcaccgcggttgcgtatgtgtaccagcggatcacaacgttgccatgaaatctgtgcatttcaaggcccgtttgggatgtgggttaactcagtggttctcaggtgggggaggtatcatgatttaccctccagggaatacttggccatgtttggagaccttttttggttgtcacagctaggggaggggtgctattggcatctggtgggtcaaggctagggatgccgctgaatattctacaatccacaggaccaccccgccacaaagaagggtcccagctgatatgtcaggcttgccacggtggggaaaccctgatttaaagtaataaaaatttgaaactacagttgatttagtacatggtttgctggtttatttctttaaaaataaacaacagcaacaaaacccaaattaatgcccggtcagtgatgcagtcaatgaagagagcattaaagaccgtgtgctttaagaaatagttttagaggggagttttacatcaatgtcacatgaggaaactaccacttatgctcactaatgggaatgttcttccagtctctttaccccaggtagaggtgcaacattttgcatcaacaaagtaggcagcattggccttgaacagtaagcattcttgtcttttttgagaggaaaaacagtctgggctattttaaaggagctgtgactcatgggggcatgatggagtttctggaagtgtggtctcctgggtagctaaatccaaatccctggaatactggctaaagacagctacctgggccgggcgcggtggctcacgcctgtaagcccagcactttgggaggccgaggcaggcggatcacgaggtcaagagatcaagaccatcctggccaacatggtgaaacctcgtctgtactaaaaatacaaaaattagctgggtatggtggtgcacacctgtagtcccagctacttgggaggctgaggtaggaggattcgcttgaacctggtaggtggaggttgcagtgagccagattgcgccactgcattccagactggtgacagagtgagactccgtctcaaaaaaataaaaaaactaaaataaataaaaataaaaaataaaaaaagacagctaccgagacccaacctcccttccccagtgagaatcttgaggggcaaggcccaggaatctgcattttcacaagcttcccaggggcagggggttggtatatgcattaagcctgagaacacttgctgtggtggggaaactgttgggttggaagtgggtacagctggcatttaatcccagactgggtggccttgggaaagttacttacctcttggaattgcattttcctgaagtgggtacagctggcatttaatcccagactgggtggccttgggaaagttacttacctcttggaattgcattttcctgaagtgggtacagctggcatttaatcccagactgggtgaccttgcgaaagttacttacctcttggaattgcattttcctgaatgggatcgggatgtccctacagatctcctatcattttaggctggaggacactgcctgatttttcctgaaaccgaagataattctcatctgactgtggttacctcctagttggtgtgtctgtattccaattttgcaagcttaaaatctgtccattcacctgtcttatttttttaaaatctgtactgccccattctacattatgactttaagatttcagctttgaatttctggtcctagttcagatcctaaggtttggaaaagtcagaaaacagatctattaaaaaaaacacacacacattaaagggaaagtacttcattacattttaaacagcacctggggggaaaagtctagaataaatgcaaaaatgcaaaacaaaatttctattaaaagtaacagggcgatggatgaccattttgactttttgcaaatgttcccttttcatgctaaattttaggggttgatctgaaaaagcaacaacttgttctttgttttgaacgctctggtgaaaccatatgcaacttcctctttgtgctgtgtaaacctcaggtgtctccagctcttcagccaggcaagggcttggctaaaaggtgcactccagggttggaggagccttcagcctgggttcgacttctgactcagctgtatgaacctgggggaccccctccctggcttgggtctttccacatctggtccccagatgtgaaaagactcaagacatctgattggagtctctttgggtcctgaaattgaatgagagttgatggccaacaaagattcatgggaagggaaggatgtgtggggtcctggtcatggtgacggatatttgtgattggagtcggccatgaatttaatgtgcttctgtttctttcttcaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgtaactatcctttatgggcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcatgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgctgccatgaattgtagctgatttatgagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaagttaaaatggtgattcaaacaaatctatagtgaatctgtgtcagagagttgtgtaatcgtcatgaaggaggcagcatgatggtaaagatggtggacagagaatccgaggtgctggtgaatgtggcccatgaacgagaaagctgagccaaagccgatgcccgacccggacagtacaattgcggtttggggcgtttgtagcctaatcgtctgcaattagcacctaactctactgagcgtgaaccctagtcaatactaaatagtaaggccaacaaactgaccttcccttggagaatcgggtgccctttaggaggaaacctctatataatagtctggggtgaccctgaaaggctaagcagtcatctttttgcctcatttcccagttttggacaattttttttatcaccaaaaagtaaagtgtgatttgaaggaatagagaagtttcttttggcccctactgccacccccaagatcagtcaggcttgaaccggcaggtgaccccaacttgtttatagcatggggtgcagccagcatcacctgctagtgatgttaaagaagcagcaggaggttctcaggggtgaagcaatgtagcatttgcataattgcctacaggggcccactcgcctctaacctcagtggtttgcaggctccatggtgggcgccccacctgctccctacttccccatcagtagcttctcagtgaattctttaatctatcgaaatggaatcaaaattcagccaggaggaaacagtgggtaaattctgtaggtcactgggaataatgaatttttgtaagtgttggttgtgatacgtctcacactgataaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatttcctgccaactggcaatacaaaaaagaccccaacctgccaacacgttttgccaggaaatcggtgagtgttttcaaatgccctgtcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaacttctctcttttgactttgctgatcagatgactgaagcatgggaaaaaaattctgtgcctttcccaaaccaatgaagacactcactaacttaatgtttccttaaactcagcatttacagagtagattatggcttcagcaaaggctgtgatgcctccgtgccatgtgtcatggtgtttgtctggttttctgtaggcaaactaggcgtggcaactgctggctgcgtgaatgaagttacagagatggagtgcggtcgctctgaaatcgacgagctgatcaaggaggtaagcagaggcagcatttcaggggtctggccctgccaggaggagtctcatgtcttctggcagggaggggcaccgttcttgctgtatgaaggcagccagaccctcgggctcgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagtgaagttccttccagctccaaactgttcgaacactttggacagcagtcttttaaatggcatcgtgaattcccttgccttcctagcaggctacagagaacaaaatgtaaactttccttgctgcctgcgcttgtcatgatggcgggtgttgttgtaccagctctcatggctatttgattgcttcctttttaatgtgcagtttttattccttaacggattggaaagctggataaccaagcatgttcacattgcacataaattcctaacaggctacaagggagagcataatcggggcctccttaggcaagaatacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagcaataatggaatccttaagagtagcttggctgtcagagaatgaagataacagaatgtaacctacccgaacggccttgctcttctgcacaggcagctgccaagtgtctgggtggtctttggcagccgactgagtgaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagattgaacatctgcatgtggctcgttgagcgagattcttgaaagcatggcagcctttggccagcatcactgttcactggtgtctcagagcttgtctgcgtgtccagggcgttgagggcaattggataatctggaacactgggtctgcaacaggcaggtcgtggaaagggccaagaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttccccgccggaggcctgtcggagtcagctccttccagactggtgggcgcagcagcccagcacaggtgagggtgggtggcctagaattgtcaccaggcatggcctgaagggtttacggcattccaccagccagggacggagtgggggtggttgttgctatcatgatccatgtctcattaaaggtagctcagccctgagaggtgaagaacgatggccctggtttcccaacatgagggcagagcccagctgtgcctttggccctgctctccgctgcttctcaggagggcacaagctgcttgttccctaggtgatgtccatgccagctctccccacgctcctgggaaagtccagggaagagggtctagtgaacttgtgtaaggccagagggaagatgcagctcttggccacgctggcgccccctccctgggtactcccttaggtcggccagtctgttacgacattaaggaccccctcagaaccaaagagagcccagggcatttggaggagaggagaactcagaccaggaacaggaagtttgttcagagccctagatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacccccagctgcttgaaatgcccccgcccccgccaggcccaggcttctgcagccggtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggtaagtgcttgaggtgggaaggaaatgtggccccacagtgtcacattgacacatggtcagaaatcccacagcatagaggaagtccccccgacttgccactctggttttctgcatttgtgaaacaatggctctctgctctggtggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcaggcgtgccgctggtgacggggtacaccacctacgacgcgcaccattcaggtacggggtggtccgggctgagaggggcgtgggcactgtttgaagacaaagcccagataacccaagcagggttgcggggtttcgaggatgagcaggacctggtgtggaagtctaggcctggttccaaggatgagcaggacctggtgtggaagtctaggctccgttccgaggatgagcaggacctggtgtggaagtctaggcctggttctgaggatgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtggtggagcctctcagagcctcatctcaggctcccctgcccaccacctctaggtggatgcagctgttcccatttcgcgggctcaggtagcttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgcatgggacagttttgtgggtagcagaggtcggtgctcacccaggcaggaaaactgtcgagatggcaatgccctgtccatgaagctcttgtctatttcctggcagccctttgagctggggggttgttttcactccggcttcacagatgaggagactgaggctgggaggttcaggatctcatccaggtcgcgcaggcctctggctggagcctgttcttgaggcctccttgtgcccggcagccgccatgctcacagggtctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacaatttggggagagcatgtccttgaattagtccagcagggtcatagccactgcctcatgcacagaacatccttctagaagctgtgagctttggtacctctgtccagccccgcccccacctctatgtaaatccatgcttcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcagctgggctgggaccgcacgtcaggcaggtgggctgcagggtctgtgctgcgggtgtctttgttgctgcctctgtggtcaggccgttccccagcaaggctgttcttgtgggtgagtggctctataagggcagggctgggtcgcagcaggcccttactgttgcagaaggctcacctgcctcaccttggcagcccttggtgagctgcttctcacctgtcaggtacaagcctgacagctggaaccttctcttagcataagacgttctggggtgtgtggtcactaagacactcctgcttaggcgtctctgaagcacttagctgttccgggtgaagctgccagttcacatgactgagaggtgctggtaccaagataaggccccggaaatgacagggcaaagggccaaaggggtgacggagttgcctgaagcgtttcattcatttggaacaaagttcgaaagttgcttcagggtaaagggaggggagtgtgtggagtccgcaggcagtgcagaagttgcagacttggcgtggggggaagatgatgagtgaggaagagcgagaccagcggggaagatggtgagcagggaagagcgagaccagtgctgccatttccttctgggtgaccctatctaggattcagtttcctgaagtgtcaaatcaatgaggtggaccagagcttctgcagctctagcttcctaccctgcatgattctagaacctgcgtaactccagcatggctggaaatggagcccgtgaatggtgggttgtcaaataataaggcagggagcagagcccaatgggagggtccaaggagttctgagtgcccagcagtgtcagcagggaatgcagatggactcagggcctccccagatgtggtcagccttgcacaactctagggggcgccgtggagttaggcacctcacaacttgtgtggctccacaaggcagcctcgaaccggtctggggtacttagaaggagctgcaaactcactaagctcattgctagcgtatgtaattcttttggtttaaggcaattaaaatgcagatacctccctgcatttacatgttatctgcattcctaccttagattagtgttttccaaactttggtcacttgaggtccagtgtcacaattggttttcacagcctggactgttactaacatcatgtttttcctcaaatcttaatcttaaaataaaacttaagtttattttaaatgagaacccactatcattggctgtaaaggaagacctgtggcacctggtataagtaggtaatactgtctggctagaattgattaagattgtatttgtctttcattgaatttgtcttgacctctgacaatgccctgaatttggagccctaagttcagtgccattattcaaaagggaggttgacaggtgttaggtgttagagagctatcagcaccaaactgaggcttgctttttgaggtaatcagaggttggaagaatattgaagatggaataatcttgtgattacatgtatcacccctcccccattattctgtgtgtgccacttttggggaacccctgctttagtttgagtgtttttcagactctttcctgagaacagatttggatgaagggttttgcagagattcttaatctgaaatccaggaaataccaagggcgctgtgaatttgttgagaaaaagattatgtctttattttctttaacttcaggtttaaattgagcatttccttttgttatgaatgtaggcagcagaccgcagtgcccttggcagtgcctatgagacggagtattgtcataagaaatgagttgtcgaaacatcgtttgccctcagcttgacgtgtaaattacaacagttaccagaccttctctagaccttgtatttaaagagtcagtgaagaagtacagagaacactgttgtagttaatatgttcagtcattggtttccttagtcattctgtgtatttattcatgcatataaaaacattacttctacaagcagtacatggatttccccagaatatcaaagtggttcaagacacacaaagagttacccgtgtaggtgtgagacagactgtgcacttgggcaggagggaccctgtatgtctccccgcagcaccgtcatcgtgtccctcttgtccacagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgaggtctgtaccgtcgtcaccttgctgcccccacatcttagagatcacgcctcctatctgtgtgccatttgcagctcagggtggccctgtggtctcatggagggatgtggaggaggagtgaggggcatggtgtggcaaggaggtgctcctttgaatggcactctgccctctccactgagcgatcctggggtgcttctctgtgcctcaacttccccatgtgtacagtgggggtgcagaatcagtaccctcatcaggtgattgtcgggagggtaaaggaacttaacctcatgtaccttggagtatgttccaaggatggtccctgagcgctggctagagacacagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggataccagcctgggtgtctcctggagggttaggatggcgtctcccttctccacgtccccatgctctctgctcctctccctgtagcagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgcgtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagaggcgttcaaacgaggcattaaaatcccggcaacaacctggaatggccaaacgaacagctccttgcttggaatttggcccaagggccaccagtttgagatcccatggtgccctggcctaaatgctacaagccctgggcctcctgatcccccagccctgctgctgcgggagttggaggtcatctcggccttgcttgcaaacaccctctgcctgtgtcattccagagctgcagcagttctataacagccagggccggcttcctgacggcagggtggtgctgtgctttggggaagagtttccggatatggcccccttgcgctccaaactcattctcgtgcaggtaagtatgggcagctttttttttttttttttttttttttgagatggagtcttgctctgttgcccaggctggtgtgcaatggcgtgaccttggctcactgcaacctccgcctcccgggttcaagtgattctcctgcctcagcctcccgagttgctgggactacaggcccgtgccaccacgctcagctaattttttgtatttttagtagagatggggtttcaccatgttggccaggatggtcttgatcttgtgatcctcccagcttggcctcccaaagtactgggattacaggcgtgagccacctcgcccggcagtctgggcagctttgagccctgcatccaggtctcctggccctgtcatgtaaggatcaagttttgggctggagaagaggacacaaggacaagtttccacctgtgtaggaggcaggcctgggcaagaccttcaatatgcgggaagcggattcttgccatctccgagccatcttctggtgtctgggacgcgcacagtctgtgtgtgtgtgttttcttttttcttttttggtttttaaatctaagcctcttctccagaaagattctacctgttcagttgcccgaaggtctaagtgacagattagggcattgccagcccttatttcatgtagtcaagggaatgaatctctaatggtgggatcctgggtgctggctgtcccagctgggacagtactggggagtatggaacagttttggcaggagtactgcttgcccttccttggcattctggctcattcacttgggactcacgtggcactggggtcatcagaggacctggctagggtcaaagacagtgcccaccccctttggagcctccgcctctgcctctgactttctgcacctcccatctagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccaatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaa

SEQ ID NO: 1828 - DNA, 2147 bp, Homo sapiens
  source 1..2147: mol_type = genomic DNA
taacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgaggtaagtgttaaacagggatgatcacagcttcaagtaagcaatgggaattggatgttttatgtcctctggcgccatcttcagcagagaaatatataggtcacttttacttgtctggttttggtcttgaaatatgtactgaaacttgtgaaggagcagacctatattaggatagagtaaaagagggaaagacaaaaacctcttgggcttttcaggagacttggttcattctctgcttttcaagccatctcatggccacatgcctgctttggaggctgactcggaggcacaaccggcctcagggcgttcctcagggaccctacctttcttgctccctgaagaaatgtgcacattgcttgaataaaaacaatcaaagaacactcagtcaagatcgtctgctgcagtcttcgttgagggctggggatgctaaaagtcagatgattcatgtgtaccctgtccatcctaactcacctgctcttctacttccgcagcttactccagtgcccacagatacgacagagtgtcccaagtgcccctcacactctattagctgcatccttaacctctttttgccacaccataagcattgggttttgtttgttttgagatggagtcttgctctgttgccaggctggagtgcaatggcgtgatctcagctcactgcaatatctgcgtccagggttcaagcgattcccctgcctcagcctcctgtattagctgggactacaggcgcacaccaccacgcgcagctaatttttttgtattttagtagagaaggtttcacgatgttggccaggatggtctcaatctcctgacctcgtgatctgctcgcctcggccttccaaagtgctgggattacaggcatgagccacggcgcctggccagcattggggtattttattgaagatggaagccatgaatgttgagaaagcctcagcagatgggaacttgccagaggtgatctctaacatcaaggagactctgaagatagtgtccaggacaccagttaacatcactatggcaggggactctggcaatgggatgtccaccttcatcagtgcccttcgaaacacaggacatgagggtaaggcctcacctcctactgagctggtaaaagctacccaaagatgtgcctcctatttctcttcccacttttcaaatgtggtgttgtgggacctgcctggcacagggtctgccaccacaaccctggagaactacctgatggaaatgcagttcaaccggtatgacttcatcatggttgcatctgcacaattcagcatgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcgggtatgtgaatactaa

SEQ ID NO: 1829 - DNA, 1073 bp, Homo sapiens
  source 1..1073: mol_type = genomic DNA
ataatagggccggtgctgcctgccgaagccggcggctgagaggcagcgaactcatctttgccagtacaggagcttgtgccgtggcccacagcccacagcccacagccatggtaaggcagatgtcacaggtggggggaggtgggctctgtgccagccaattttcgtctccctcccccagccaaggtctcccaggggtgcagggagagcggagctgctcagagcttggccaggttctaagtgtgctcctgaaagcaggtcacccctgagatcctcagggtggggcacagaggggcaccctagcaggtaaagggaggccacgggatggcggtgggcagctggccttctagtaacgagccctcagtgccttctgtgcctggggtccctgccggcgggatgtagaggacagacaggagggagcactgtccctgggtacaggagctcgccctgcagccagtgccttgtgtgtggtgggcctggggctggcgccgcagtctctgaacctgtgtgacgcctgcagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtacggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaa

SEQ ID NO: 1830 - DNA, 74203 bp, Homo sapiens
  source 1..74203: mol_type = genomic DNA
tgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatggggtatgtgagcagtttcatttgtcttttttcgcatagcattttatgtttggactgggctaatgcaaaaatatatacatagcataaaatagagcacaggaaacacaaacatgcttattgtaacaacataaaaagtacagtaaaagtaatcagaggagaatgcagagagcagtcaagaggtgaaatggtggtgctaggtgatttcagttctaaaaactgtaaatttaacattcatcagctttttccccctgcaaggttatgtttggtttttaaattatgaataacattttaggtagcaagtattatgattcgataaaacttgaactttctatgaaacatactaaatttaatgaaacatactaaatttaatgaaacatagattaatacaacactagcattcaatgggatgatctaccccagctttcttattttttagtggaagaaactggtgtttagaatggttaagttttgggttcagtgttaacgttttcatgaataactctgtttgtctcaatactcgtcgctagcctgatcttgaaataagatttcccaggcatttaattatctaaaagttgtaaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtttggtagaaaaagcattggacaaagggtcaggagaccaaactctacttctcagtaggtgatccagtctgggcaaatgtctacctcctgtttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagggaaaataatattaggtgcctgatggtcacttagaaacaaaagtgctccagttctttgttggagtctgacttagtaggtggtggcatgagtttgggattctttggtgtgccagggtttaaagcacttcatgagatggagctccagaggaggtcaggctgggtatagagcctatggatgcctcactttttaaagttgcaggtgttgcatgtcttttgtgaattaaaaaaatacagaaaacaaaaaagttgcaggcgaaatagctctgcctctttagaagtgaaaagaattgcttgtcttattatcagactcttactgataacaatttaccagtcaatcagaaaacacatggaattacgtgcaagtcctctttgctaggtggccaggagcccagtttgtgaacttgggggatttatcatgtagagctaataaatcgcatggcattactcaatgcttttttgtgaatggaacatttaaagtttttgtttcatattgaaagaacagtcatgtacctttaaatatttttttcaaagtccattttgcagttttcaccagttcgtttttctgattcaacatagtatcatctcatttagttagtattaataattccttagcccaactgctatttgtgaactgattgtgaattcagctcaatattatttgtaagtaatcacaaaaccagatggccttaattcagaatattattggtcataatttgcatgtagacaaggttgtaaaatcaccctacttctttatctgagcattatggaaaatttcaagacaattacttcattctggggagccctaggctacagtttctaattcttccatgtgagatatagagaatacatgtccaaacatcaaatttcttgttttctaatgccttttttactcttataaataacattttaaaagtatttctttaattatttaattattatagaagtttattaattagaaatttatccaagttccctgaaaaaggtaatatatgtgaattattattgttcatgtcttaggtatactacatggtttcaggccaccaatttgcacacaaggctgcattaatattactcataagtaaataacattacacttatgggaagaacattttcatttttaaattaaaggcttcattttcaatctgtaaaatgggtgtgataatagtacccatttcataggaagatggcaaagactcagaggtataatgtctttaggctgaactttttgaaattatttggcagatcgaatatcagatattagaagtttcaaacaattcaacttaatatattaggtacttagcataggccctgtcatctggtaagcatctagtaaaaattaaccattatttgtatccctttcatgtctctacagaagctagcaggctgtcataacaattcattttcaaattatgggagatattcaaggattcttcaaagtcaagctaagatcagggtcctggattccttctattctgtggctaaatataagttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatggttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacaccgtcggcaagcctaagtacaaatgatccttggagaggtagccaccaactaaacagcatacttagttgcatgtgactgatatcggatccttttcagcggtaaagggaaaatggagagcctcaggcactttgagtaagcacaggatggaagaggcagcctaaatgggaataaagcatcatagattggtgtggctcacgtggccactttctagatgtgggatctcagaccagacacttgacctctttctgcctgtgtcctatttgtaaagtaaggaccccaacactacctacttcaagtgatgttgagtatttcatgagaaaagtatgttataagctttttaccaattgctacatggtaaggtgattattactcacaattttgcccaagcaccaccttggtcttctgaaagcccctctggagaactggaaaggttctcctattttgatgactctttgccccttagggatcaagtgtgctgtgctccttatgatgtgggaggcattatcatttacatggaacaagagaaacagtcaagatcaccattccagtaagcatctgggtgagggtctccactcctcatggccttttccctttagcctacagtcttatctagcaacagaaccatctcctgcttgcagcaagcatcctttctaaattaaagatggtaggtggggagatggtcccctttccttgcttttgaaagcattactgctagtgatcacaaacactgcttctggaatcagacagatctgggtcaaaaactagctcacatttgatctgtgtgattttgtataaattatataatgctgtgcaattctctaaaaagctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctggtctcgaactcctgacctcatggtctgcccacctcggcctcccaaagtgctgggattacagatgtgagccatcgcgcctggcctatgtttttaaaataattaagcaaggccagacacagagactcacgcctgcaatcccaacattttgggaggcctaggtgggcggatcacttgagcccaggaatttgaaaccagcctgggcaacatggtgagactccgtctccacaaaaaaaaaaaaaaagccagatgtggtgctgcatgcctgtagtcccagttacacaggagggtgaggtgggaggatcccttgagcccaggaggttgagactgcagtgagctgtgatcatgccactgtaatccagcctgggcaacaggctgagacctggtctcaaaaataaaataaaataattaaacattccttcatgatcttatttccttttaataagatggaggtcacctttattctcataagatagtaactaacatttactgagcacttactacatgtccaacactgtgcaaaaatgtgaattatttcacctaaccattataaccactctgtaagttaggaactgttattaccccaatttgtaggtcaagaaattgagacaaagagggtttaaacaacttgcctgatgtcccacgtctctagagtctacattactctctgataaatagtacttattaccatagttgttactcataggtaatcagggattccattgggttattacacagtatgcaatacattcttgctctgaagtccccagtgtaaaggacagtcctgaaaattggtaccccctgccaaatgggtcttctgcaatgaaatattttaggacctctacgttttccacaaatgccccaggacaaatccttgtctttattcacttcaagaagccccgctatgtgtcttaaaaaaaaaaaaaaagagagagagagaggcgggcacgatggcccatgcctgtaattccagcactttgggaggctggggcaggtggatcacctgagggcaggagttcacgagcagcctggctaatatggtaaaaccccatttctactaaaaacacaaaaagttagccaggcatggtggcagatgcctgtaatcccagctactcgggaggctgaagcaggagaattgcttgaacccaggaggcagaggttgcagagagccaagattgtgcgattgcactccagcctgggcaacaagagtgaaactccgtctcaaaaaaagagagagagagagagagagagagagagccttggcaagctttgcctcctaaagttctcctagaatctccccagattcccacaggatatctctcacctgggactgtcagcatatctatcacctgggactgctaccacctctcatgttgtccctgcacccgcttcacccctgcctgccacttcatcctccacatggcaaccagcaccagcttttcacatgtgactgtagtcaagtcctgatgaccttcatcagacgttgatgtgtccctacagcggctctccccattgccctaacgatggacaccagcagaatctaacacatggtctcgtctgtctcagctcatgtctcactttccctcatctctggaatccaaccacaccaggttttcttcaacgttaaagcctccgttttaagtgtcacttacttgggaaagccttccttgatgtccctagactaagtcatgtcctcctgtcctgttctaccacagcaccaggtgtcctttcttcacagcacatgctgaagttgtaactactcatttgttaatgtgatgatgtattaatgtaatttccccacctcaccctccattgaactatcagctttatgagagcaggcacccaagttgataaagatggccttgccagtgtctacaagagtgtctggcacacactattcactcatgcatcatttgtggagggaataaaaggagaaagggagaaaagaaaggagggagtaaggacataaggtatagattcagctggagaggttagagacacaaacgaagctcaaatagagaaggttcaatacccaaataatagagaccaaggcaagtgacataggacttcaaaagggagattactgggtgtagaaacaagtaacaaagactccctggaggtagtagtgtgtggcctatcgttgaacaaggaagaggaagattcagatattcaggtggttggaattttaagtgctgggtcagaaaggcacatgtaggaactagcaggagggccgggtcccagccctcaactctttttaggagaattaagcaactcttttctcctttttcctctgcctgtcttacccctccttccttgccttttacagctaaagcctccgtagataatattctttttttttttcttgacccagaaccttgctctgttgcccaggctggggtacagtggtgggatcacagctcactgtagcctcagcttcccaggctcaagtgatccttctgcctcaacctcctgagtttctgggactagaggcatgcaccatcatccttggctatttaaaaaaaaaatttatagagacagggtctcactatattgcccaggctgttctcaaattcctgggctcaagcaatcctcctgcctcagcctccaaaagtgctgggattacaggcatgagccaccatgcctcgccatgcagataatattcttaaaactacccaggcatttttacttgtgacattgagcagtcatgggctctcttctcttcattcccatgtcattcagttgccttccagctgggcttctgctggcatttgaagttttttacagtctgttatccacacaacacctagaatgaaccttaaaattttaaatcagatactactttctaccttaaaaccctccatggctatttagggtatttaaataaattctcaactatgcccttcaagacccttcatcctgtggtcccagcctgccttctttatttcacttcacaccacactccctttatgtgcttctgtcacatctgccttcttcctgaaccataagcactccaagctcaaggtctcagcagggcctttgtacagggccaggactagggtgagacaagtgagacacacacataaaatggcactcattctcaggatgcaggatctttgcattagctgtttccactgtctcaaacaccccagatttttgcaggagggtttgtttgtttgcttgtttgtctgaaacatggtcttgctctgttacccaggctagaatgcagtggcggaatcttgggtcactgcaacctctgcctttcagactcaagcgatcctctcgactagctgggactacagaagtgcatcaccacgcctggctaattctgttgttgatttatttcccatctcttcaaagcacatagataccttagtatctgcatttatttgttaggtttatggatctgcttccctgtttaatttctgtctgtccatctaatggaagggcagttccatgagagcagagatcttgactgtcttcttcatcacagtatcaccatcatctaaaacagttctgggcactggttagttgtagtaggtgatcagtaaatatccggggaatgaatgaaggtcacataactcatgttgcattcagaaaagcatctgaaagctaaaaatgtgggccttgtctagccacacagagacaagaaagggcccaagcaaagtactttgcaattgagacatgcacagtttgcatctgttttaatggagtgtcatcatgaattgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcagcctgggcacagtggcttatgcctgtaatcctcgcactttgggaggccaaggcgggcggattacctgaactcaggagtttgagacaagcctagccaacatggcgaaaccctatctctactaaaaatacaaaaaattagtcaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaaagaagaagagctcagtttcttgaactacaagctccatgtaaaacaagacatgtaaatatcaaacgtggaaatcgtgtctacaaaaaactattttaaagctcttcgcaaatgttcatggaccaaatagtaaatcctcattccaccctcattttcttaacgaactaataatacattcctcccattcatcagtgaattatgaggcctactggaaaaagtagaccttccaggacataattttcatccagaggtcagtttgggtttggcttcatgacactcagaggcctcactaaaagtgatcctaaggagaaaacaggtctgtaatgccttcccatgcatataaaagtccccttttggatcaacagtcttctcagttccttgaaattcagtaaaagttttctgtattttaataaaataagagctagatacaggttcttatgtcttatgttgccatataattcctattaacctaaagttatttgtaagtaggcttctcattatatttttccttttctgatatttaaaaagtcacagaaattataactgtttgttataaaaattcaactatagggatttttccccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttatttatttatttatttattttatttttttatttttgagacggagtctcactctgtcacccaggctggagtgcagtggcacagtctcggctcactgcaacctccgcagtggtcttatgttttaacttttttgtggcatccttcttcctgggggtactttgtccagaatcatctcactccatgttttgatgggaaagtgcctggtgtataacctgcgtcaggatcaacactgagctcagatagacagtagcagcaaagactgaaaccaaattagaattgagttaaatcagctttgattaatctcaagacagagcaaggaatattctgatcctcatattgtcaaaaaaaattaatgaaccaagtacattcagaatgttttctataatttggtctgaagacatcaatttactatctgtgtcagcactggtcttttccctcatgcagatgtatcttttgcagagttataatcataatgcatgacaattttatattctacttttctatctattctttcatataaatgtatttccatatatctacaatgcctccaaagtaatcatttttcatatatatgattttttaatggttgagtcagttcattgcaagaacatgcttatctattttatatacgtggaggaataggtgaacttatctgttagctatggttcaacattcaggttgtttccaggtataatgaaaacaccaaaaaaaagcagtatacataatatagggctgtctcatttttaaaatcagcttcttaggatagagtgccccaaataggataattgtgtcacaggataagaacattttctggtcttgatcatttattgctacatcatcttccaaagagattgaagaagcagtgtgtgggccaccaaaagcggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttggtttaaagtcagtgtcacatgtatgtagatgaacccaccacctgcatagttggatttaaggggtgccaaaaggtctcctactctgcaaaacctgaatgcccgaactgactgtcacagagtaggggtggtctgaaaggttcccatgaatgagctctttgggttaggtcatgaaacaccttatcaaggagcaaatgaaatacaagaaggtgtcacaggagccacttttgactgttccgtagaagttagttttaattttagacagggcctatgacactgaaattctcaggctgtaattccagaaaagcggatgaggtgagcaaggaacaacagggcagcctaatagaaaagagatttggacccgggtcaccgggctaattctttactctctctgggatttagctttcttgtccataaaatcaaaggattcagctgatcaatgctttttcaaaatttaaaaaacattttaatataaaattatacaagccatcaccatccccacatataaaacagagagaagtggaagttctctgcttgaagcagggcagggaaactgcccagaaccctatgccccttggcctgtcccttactttcagggatcaacaagttatcttccaactctgtgacccttccccctgggatgtaaattgaatagtagaaatgaaaagacaaagccagtttagaaagtcaccttgaaacctcattgtcctcatctctaacattataaagttggactgaatgatttctaaagactcttccagttcaaaaacatggaaacttggctcacatttgtaataccaacactttgagaggttggcattacaggatctcttgacggcacgagtttgagaccagcctgggtaacatagtgagatcccatctccacaaaaacaaaaaataaaaaaattagctgggcatggttgtgcacacctatagtccagctatttgggaagctgagggaagaggattgcttaagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatggaaatctttccaggaagtaatacctttagggtgattaataactgtgtggctcatgagaaagcatgttgtcaaaatacaagcatgaccccaagaacgcaccctaaaaatgaagtcagacatttcatgtgtaaccaatacaaaatctgaaataataacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggcagagttggggcaaggatttgttggtgagtttctaacataatccaatagaggtgttgagtcgggaccagcaggcttgctccagattgcccagcagacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccaggaggaaagtattagcctagcgaagtgacccagaaagggagtttgagggagctaataccaaacctcacccttttccacaatccatgctgaggccatttccatgacaatgatccaatttggtgtttcccaaagtggggtactatcaggagcacacaagatggcacatggacaaatctggttttaacatgtctttaatagttatgtatctactataatttatgttagaaataagtgttttaaaatttatggtggtaatttaaagtttcctcctagaataaatttgtttatgtggaaaaaataagtcaattgaaagaatactattgagcagacaatactatttgagggaactagggtatggtagaaattgccaagctaagttggaaactgaagcctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtaacaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcattctgtttatggttgcataatacttcattgtatgcatgaaaaatttcttttaatgaaggttggtctgtttccagtttttgttattatgcacaatgagaaatgaacagccttgtagatgtgtcattttccataaatacttttataacagtggttctcaaccaaaggtgattttgcccaccaggggacatttgacaaaacctggggaaatttttggttgttataagtggggaggagggtgccaccaacatctagtgggtagaagctgagggtgctgctaaatatcctacaattcacaggacagactcacaacaaaaaattattcagcccaaaatgtcaataatgctgaggctgagaagctccagtctgtagaaaacatttctagaagtggaattgctgagtcaaaggatatttgcatctgttattttgttgactatgagcaaattactctctacagaagttgtaccagtgaacattccccagggccacatgtgagaagcatgttttctcaaaacctcacaaacaccattatcttatgttttgatctttgctaatctgataggggtttaaaaaatagtacttaagtataatttatttgcatttctgttgttatagtgacattaagcatctttccatatgcttaaatatattccttttgttcattttcctataagtttattagtattttatttaatttgtaggagctctttaactaccagctaaacactttgggcagactagttttaacctacattttcattgtcaagagatttttatccacctgccaatttttctggaaatcttattccaaatcatttccattaaaagttttgtcatagggttcacaataatcactttctgctgcatacttggttttacttgctgttccttcaatcaattaacagatattaattgaacatcgcctcagtgcaagcagttatttcctgaaatgcaatgaagtttttatgcacttatgtattttggctactggtccttcagtgcttaaaaagaagacacaaaaaatacgttctttcaaactcatttaacatttcatatttcttattctgggaggaaggtctttgaaggaatattcacagctcagagatactgacagaaacaatacagaggatgccttgagaatctactttatgcttggaaaatatcacttagttcttgctcctaatttccacataagtccttttctctctgctcccttttgtaagaaaatctaaacacacatgttttcaacatgctaggatcatgttaccttgatctagtaagaatggggcttggacattattcctgagttatcatttcacttataagataaatatacccatataaaagcacactgaattactttattagaatctatgaagaaaaaggctatccctcaagaagaacatgagagagactgtcatgtacttgaacccccatggatacagatgagcaggtggcaggtgctctctagctgctgctcactgctaatggggttatgcggttacaagggcgtgcatcatttcgcacacccagcatttgatgcataccccttattcctctcccataatcatctaagttgacactatgatgtttttgaaacttctaactgtattaaaatattattttcatttctctgcttttcctcctgcttcacactctctgtaaaaacttcaaatatcataagaatatataactttgtgaaattctgccacagtggaacctacaacaaagaaccagtgttagcagcttggaatgtttttcttcttgtattatttctttggatattgcatatactaatacataatctcttcttccaaaaatgggatgatgctccatctgttgctttaaatctgctctttaacacttggtatatacttttgtccctctgtatagatgaactttattatctgttaatggttacagagtagtcattatgtatgatgacgaatttaaccatacacagatggatgtttaaccataactaatttaaccatttgtctattgatggatatttaagtttttccagtttattttagtgtaataaataatgcttctgtgaaaatcctttttattacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccagcccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaagccagccaacggtgggccagtgatgagtaagaggtcttatggaaaagaagagagaaacgaagacaggtgtgggatggatcagtttcctggctttaaggtggtccagggagccttgaaattaatggtcttagctccagactttcccagagctttagaatagagggaggttaggtctagctgaagatgggctggggagggaggaactaggaacagctcattgcaaattgctctggtgttttacaagatgctaatttttccatagagacagtaatgagcatatcttttttgttttgttttatcttgttttgtttgagacagtgtctcactctatcacccagagtgcagggacatgataatgactcactgcaacctcaaccccccaggctcaactgatcctcctgcctcagcctccggagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattataggcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacacataacttctcatcgacacatttgctgggctagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctacgtattaagagggttggcctctgtgaacttcaattttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttctctgtgagatctattgaaagtcagcccttaatacaagggtttgttaaaaaagagaaaaagaaaaagaaggaaagaaagagagaaaggaaagaagaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacagaataacaagtaagaatgagagcaggttgtacttggcctctccctttctctggtggcttttgtgtggtttccttggaaagttttaccctggcatttttcagaaatagcacagttgtttgggatgattataggcaatcaccctttcccagagactgaactgtgtcgggctcattgaccagccaccccccggggaccaactagggaggacatagctggtcctgctgtttaccaagtattggatcttgtgagatgccagaagaaccaacctcagggtctttggaaagactgaccaaccagtcaggatggattgtggtggtggatcccaagcactcatttgggaatgagagtgacgttgacggtggaacatgaaatccatcccaacagaagagcaagcctgagagcaagctcatctgacagcctgttaaggcacaggcacaaaggaggccatgtgagttggtaggagaactcctccttggaaatcttggagtctcgctgtccactaaggtaaccactagcacctgaagtctactggcataggggtctactgagcacctgaagtatggcaagtgcaaattgagatatgcacaaaatatacaatttcaaagacttaagtacaaaaaaaactcattaatttttgtgtggataacaatttttttaatatactacaaccaagtaagattttattttcacaaatgcaatgttggctcactatcctaaagtcaattaagataatatacaatattacttgaataaatgtcaaaaaagaacatttcaataaacaaagaaaaatatttgacaaatccaacactctttgtgataaaacccccagtacactaatagaaaaaaaattttgagtcttgcaaaaagtcatctatgaaaacctacaactaacattatacttaatggtgaaagactgagtgctttatctgtaagtttgggaacaagacataaatttccacttttttttttttttttttatggagtcttgctctgtcacccaggctggagtacagtggcatgatcttggctcactgcaacctccacctcctgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacaggcatgagccactgtgcctggccaatttccacttttaacactctattcgacactgttctgcaagtactagccagataaattacactataaagtgaaatgaaattctccagattgagaaaaaaaagtagaactctttttcattgcacaccacataattttccacaaaaaaaaaaaaaaaaaaattgtaaggaacttcctaaaaacccactaggactattaaacaaattcatccatgtcaaaagatacaagatcaacatacaaattaatttttttaacttttattttaggttcagaggtacatgtgcaggttttcatataggtaaattgcatgttgcaggggtttggtgtacagattatttcatcacccaggtaataagcatagtacccagtaggtagattttcaattcccaccctccaccctcgagtaggtgccggtatctgtggtgcccttctttatacccatatgtgctcactttttagcccccacttacgagaacatgcagcatttggtttttagttcctgtgttagttcacttgggctaatggcctccaactctacccatgtcgctgcaaaggacacaatctcatacttttctatggctgcataattctccatggtgtatgtttaccacattttcttttcttttcttttctttttgagacagagtcttactctgtcacccaggctggaatgcagtggcacgatctcagctcactgaaacctctgcctcccgagttcaagcaattcttgtgcctcagccacccaagtgcctgagattacaggtgtgcaccatcatgcccagctaatttttatatttttagtagagatggggtttcaccatgttgcccaggctagtctcgaactcctggcctcaagtgatctgctgccttggactcccaaaatgctgggattacagatgtgagccaccacgcctggcctcacattttctttattcattcttttgttaatgggcatttaggttaattctatatctttgctattgtgattagtgctgtgatgaacatatgtgtatatgcgtctttatggtagaatagtgtatattcctctgggtatatacccaagaatgggattgctgggtcaaatggtaattctgttttaagttctgtcagaaatcacctaacaatttgaaatgataatattttagatattgggttaaacaaaatttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccctagaccttctcccagatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctatcatgttcatcagttcatttcctgaactcagaatagcacctcactcatagctggccctccataaatatttcctgaatggctaaatgtactagccttaaatctgtttaagattgtttaaactgtgttccaacctgacaccctttgttttgagctaattaagctccactgagggccagccactgctgggcactgggtatatgggaagatgccctggtctctgaccttagggagctcaggacctagtaggttccaaagacaaaaatgtcagcaaatggagttgtcatatcacatgccatgagcctgttgtttttatttcactatgcatgccctaaagaaagaacccaacagaggtcaaaacacagcaacctcaagctcgtgcaccctgtttaccagtagctgcagacagttcttgaaaaggcagctccgctgtgctctactatttgtgaaaaaacaggttaaccattccaaagaactgtgattatgggcaggaccagagcttgcatttctaacagtaaatgagaagatagtttgagcccaaagggcacgtttgcagaggcttttgcgggaagacaaacctcctaatttagcattagactacaaaagcaagttctagactgatatgtagagcaagacactcattttcctttatatataccctataaaagtgcagggaaaagacaaatatactccaaatgattaactttggctacctcagggttatggggaagggtgggataataacacactataaatattttcttcacatgcctctgtagtattttgttttgtttgtttgcttgtttgaaacggtgtcctgctctgtcacccaggctggggtcgacggcaccatcactatcacagctcactgcagcctgaaacatatgggcccaagtgattctcccacttcaccctcccaagtagctgggactacaggtgcacaccatgaggcttggctaatttatgtaattttttgcattgtctcactatgttgcccaggctgctctcgaattcttgggctcaaatgacctcctacctcagcctctcaaagatctgggattggctgggcatgttggctcatgcctgtaatcccagcactttgggaggctgaggcgggcagattgcctgagctcaggagttccaagccaccctgggcaacatggtgaaaccccatctctactaaaatacaaaaaaaattggggaccagcgcagtgactcacgcctataatcccagcactttgggaggttgaggtgggtggaccacagggtcaggagatggagaccatcctggctatcacggtgaaaccccctctttactaaaaatacaaaaaattagctgggcgtggtggcacatgcctgtagtcccagctactcaggaggctgaggcaggagaatcgcttgaacccaggaggtggaggttgcggtgagccgagatcacaccactgcactccagcctgggcgacagagcaagactccatctcaaaaaaacaaaaaagagaaaaaaaaaagatctgggattacaggcattagccaccatactgagcctctacagtgttttcatttgtcacaaaaaacataaatagattttgtactttcaataatggataaagttgtttttacttaaaaaactaaaaaccagacaccacaaagctttcctgtatttgatagggtctgcttctcgcatcttgaattttttttatctcagttctgttcctcagctactaaatcaaagatcagcttccgggctgaggacccaaaaacaggaagtaaagactgaattcactttgggagaatttgatgatgtaatgggtccctggatatcaaccaagcacgctcatatatcacaaatctcttgcgatagttaaggcttccttaacttctttaattgggaagataccctttattgagggcatctgttataagccagttaatttgttgacatcatcctattttattccccaatcaactctcaaaaggtaggtattatccccacttatcagatgtaaaaaccagggttctgggaagtttaatgaattgcccaaagtcacagagctcttatagtaagaggcagagacctactttaaacatagctttcccaaacgtgtgctcatttcaccatcatttgctacctccttaaaaaaataaggtagaatggggtttgggccacaatcctgaacaccataatcccaaatattgaaatacaaaatgtaaaaatacccaaaaatataattctggaaaaaataattttaaaaacttttttaaaagacatttgtttacattttaaagtggatttatttgagaaacatatgaagacatgacgaaatgcttcataggccaccttgtgcaataaaataggcaataataatatacatatttttgcaaacataaacacccaagtatactaaggacagtcacatgggtataacagttatgagcagacaaactatattcctaaagaaatagctggtattcaaggggaacgccttcagctttcgcccattcagtatgatgttggctgtagtttgtcatagatggctcttattattttgacgtacgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcattcctaaagcctacttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcctggctggattagcttttcgatgtgctgctggatttggtttgcaagtattttcttgagaatttttgcttcgatgttcatcaatattggcctgaagttttcttttttgttgtatctctgccaggttttggtatcaggatgatgctggcctcatagaataagttgtgggggagacgctcctcctcaatttcttggaatggtttcagtaggaattacattggctcttctttgtacatctggtagaattcggctgtgaatccatctggtcccaggctttttttgggtggtaggctatttattactgattcaatttgggagtttgttatggatttgttcagggaattaatttcctcctggttcagtcttgggagggtgtatgttgtccaggaatggattcatttttctaggttttctaatatgtgtgcatagaggtgttcatagtagtctctgattatttgtatttctgtggggttagtggtaacatcctctttgtcatttctagttgtgtttaattggatcttccttcttttcttctttatgagtatagctagtggcctatctatcctattaattttttcaaaaaaccaacccttggattcattgatcttttgaataattttttgtgtctcaatctcctttggttcagctctgattttggttatttcttttcctgtatcttaattacagagattatgacacaaatgtatacatttgtcaaaactcactgaaatgtacattggtaaattttattatatgtaaattatactttaataaagctgatttttaaaacaaaaaaactaatatgcaatatatttcacctttaaatttttttaaaaaagaaacagcttatataaccatggtcatctgaaatgctatgatagacaacctaagtcttttaatgagattaatcaaaaacagcagaagaaaattctgtcccaactctcagagacagactaatttgccttcagtatttgttctcttagggtccctggctgattcaatggtgtccaccaacactgagggcagatctcccccacctcgcccattctgatacacatactagtctactctggaaacaccctcacagacacaccccaaaataatgctttatcacgtatctagatacgtctctttttttttttttttttttttttttttgagtcttgctctgtcgcccaggctggagtgcaatggtgcggtctccactcactgcaagctccgcctcccggattcacgccattctcctgcctcagcctccagagtagctgggattataggcgcccgccaccacacctggctaatttttgtatttttagtagaggtggggtttcaccatgttgggcaggctgtctcgaactcctgatctcaggtgatcttcccgtgtcggcctcccaaagggctaggattacaggcgtgagccaccatgtccagccttagatactccttaatccagtcaatttgacacctaaaattaagtctacaagtccatcccttgtctatttggcacccatacatatcttaaaccacacgtaatttccaaatgaagacaataacaaagtaatagttctgcctaacaagatgcaactaacataatgaggctatcctgtgtacaacagaaaattcactaatcgtgatttttgagattttagatgttaaggacttagacttcagggatttttatcattcaggatttcagcattcaggactatgacattcagaatcgtgtcttttgggattgattggtagtgggtataatgacgtattttgcaactggttccatagctgaattccatagctgaattctcaatggcagctcaattctaggtacctgtgagaggcttcttccatccagaagcactttcctaactatctttccttggagcctgatagaccaccaatggaatttgttccattggctaaagcatcaaatcccctgagatccattctccaagcacaaggatccttagaaataggtaacatgtaacatcattataaatcacaaataccatcatgtgaattagttatcagggaaatacagctagcaagtttccaaggaaatgagacacaggcccagtagtatttgatggggaggttggggaggacatggagaagggatagttatagatcagagtcaggaatgtcctttgggagtgtcattgtgggactgcggataattaaaggacatggagaagccagaggcagaaaaaaaaaggtgccactaagggtatgcaccacaatccaggtcgggtccgagctcaattactatgctaatatggtcatggatagacacagagaagagaaaattgtcatatgtgtgtccatggatttctctacgcatctcagctacaagttctgccaatgctgccatttgtcacaagggcagtggggtacatgaccccgtgtctcactgagtggaaacctgtcaccaagaagaagactctaaaggcatgtgtccccaggagtctgctcagagtgtttatcccacacttagggccaggaggcagttttggatatttggtttggagggttggaataggtttaaaaagccaatggatcttatctagcagtagatttctggagcaatctggacaaaaatattgtcttctttcttacatgaatgggatgttcttctctccccacagaagaagcgcacgctgaaggggtccattgagctctcccgaatcaaatgtgttgagattgtgaaaagtgacatcagcatcccatgccactataaatacccgtttcaggtaagtccatcaggtgggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccatctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggcaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgacatttatttgttaattctttcacttattgaacaaaaattaagcacaaaatcttgaaaaggtggttattccttatacccctttccctcatgtcttctcttcctcaaggaaagtcctaattagtgaaggaagaaataaagctgctatcagcggcctgaaacctaatgtgctttaagtgcagtttactcatgatttgaggcaacatattgcaattgctgggtatgaattgcttggagattctgaggcaaaaagattcagattttataatctgaggactatctggaatcgcactgtctagtacagtagccactagccacacatggatgttcacatttaaatgtattaaacgatattaaaaattcagcttcttagtcacattgggcacatttcacatgttcaatagcaggacatggctggcagctactgtactgaaacagcactggttatagaatgttcctatcactgcagaaattttttttttttttttgagacagagtctcactctgtcacccaggctggagtgcagtggcgcaatcccggctcactgcaacctccacctccctggttcaagtgattctcctgcctcagcctactgaatagctgggactacgggcgtgtgccaacactcccggctaatttttgtatttttagtagagatggggtttcaccatgttggtcagactagtctcaaactcctgacctcgtgatcgacccgcctcggcctcccaaagttctactgaacagagctggtggagggtatctttaaagtccttgtatatgaatcttggcacttctggcttcaaaggcatggatatctccttgcacatcccagggtaccattcctgcttgccaacctgagggatgaacatatttttaacatggcatagaaaagaactttttttctactagaaaagtgaccctcatgagttggaattttgaggactgaaaataaaaggaatagcatgtatttttcagttgttcaaaatctcaatgataatgagtgcctaaaagagaggtgaaatataaagaagactgcagtttagttaacagtattgtaccaatgacaatctcttggttttttttttttttaatttttttttattatactttaagttttagggtacatgtgcacattgtgcaggttagttacatatgtatacatgtgccgtgctggtgcgctgcacccactaactcgtcatctagcattgggtatatctcccaatgctatccctcccccctccccccaccccaccacagtccccagagtgtgatattccccttcctgtgtccatgtgatctcattgttcaattcccacctatgagtgagttttgaaagatgtgttgtggttacgtaagatgtcatcagtggagaaaagtaggtgaaaagtacacaggaactctgtactatttctggaacttcttgtgagtcttaaactatttcaaaataagaagttttcaaaactctcattgcacatttgtcatataatatctttctcttccatgtgccagaaatatttttttaatcactaaaaacttaagatgagaaataaatgtggtttctagtcaagaggagaactttctcctgctgtcttagtttagtgattgctctcttggggcatggaatctgagacgagcagctgaaactgcttaccctgtgtttttgtagcacccaaacacctggataaaaaggatactggccccctaattacccaaatgtttgcctatatgacgataaacacccgagaccccactctcggctcagtaggtctgctgtcagtcaactatctccatgcacgctgctcaccttgaactctgtgtgtgtgtctccaggtggtgcatgacaactacctcctatatgtgtttgctccagatcgtgagagccggcagcgctgggtgctggcccttaaagaaggtaattaaactcctttgccattgaatcactgacactcttgatcctatagtagggttgggttccacaatagaatagagtgtggtgtgagagcagctgatggctgatttctcttttggggttggtggaagttcccaagttttcatcctgggcccaggaagcaataactggtatcattcagggattgaccaaatccagcctgctgtctgttcttgtcaggctctgagcaatatttgtatataactcatttcaaatagtttaataagtacctacataagatgcttgattttgtctcatggtcagtaaaacctaaaatatttactgtctggccttttaagaacaaatttgccaactcctcgtatagtatgaagaagcagagcataggccctcatgtgagatgacctgggtttaaatcccagtctgtcacttgctatgtacacttgggcgagttccttaattgcctgtgcttcagtttcccatctgtttaaaaggaagaaaaggaagggataacagcacctgcctttggagctgatgtgagcaaagtcctagaaactaggttggcccatagacagcatgcaataaatatcagctagctttcaagcttttcagaccattggtaagggtatttcttaagccttaccttcctgatggcacagttagaggcagcagtgtttaagcacatgggatgtggagccaggcatgaaggtgaaaatcccagctctgccaatgattagcatgtgaccctgggtaagttccttgaccttcgtgtgtctctataaattttgactaaaaacagtcatggagctgttgtgagaattgaatgattgaggacttagaaaaatacccatcccaaagaaagccctggatcaatgttaccattattgttctttagcctgaagcactggatgtgtcagaagatctgggttcaaatactaatctgcctctacgaagctgtgaggaccaaggataagcaaactatttgttatctctggagctgcaattcctctatctgaaaaaaatgagaatagaaatacaagttgtatcttatcccgaggttgttgtgagccttaaatcggttatgagcagacaagtgctgggtgaatggggaagtgctctccgttcttacagtcttgggacatacagcaaacacaaaagtaagaagtaatcaaaatgggctgggcgcagtggctgacacttgtaatcccagcactttgggcagccaaggtgggaggatcacttgagctcaggagttcaaggctacagtgagccatgctcatgccactgcacttcagcctgagcaacatagtgagatctcatctctactaaaaataaaaacattaggcaggcatggtggcacatgcctgtgctcccagctacccgggaggctgaggtgggagaatcacctgagcctgggaggtcaaggctgcagtgagccaagtgagccgagcctgggtcacagagcaagaccctgttcttaccccaccaaaaaaaaaagaagaaaaaaaaggaatcaaaagggccccagctatggtcattggccatttgccctctgtgaagggattttatacacagggtgttaaaactggaaggaatattagagattagatatctagttctgtggttggttcatttatttatttattcattgagacagtgtattagtccattttcacactgctataaagatatgcccgagagtgggtaatgtataatgaaaagaggtttaattgactcacagttctgtatggctgggaggcctcaggaaacttacaatcatggtggaaggtgaaggggaggcaatcaccttattcacaaggtggcaggacagagaatgacagaaggaggaacttgccaaatacttataaaaccatcaggtctcatgagaactcacgtattatcacaagaacagcatgggggaaaatatccccgtgatccaattaccaccacctggtctctccctcaacacgcaggaatcatggagattacaattcaagatgagatttgggtggggacacagagccaaacgatatcagacagggtctcactctgttacccaggctggagtgcagtagcacaagcatggctcactgcagcctcgacctattgggctcaagtgatcctcccacttcagcctcctgagtagctgggactacaggtgcatgacaccatgcccagctaacttttttctttttttttggtagaaaaggggtctcgctatgttgcctaggctaatctagaactcctggactcaagtgatcctcttgcctcggcctacgaaagtactgggattacaagcatgagccactacacccaactctgttctgtgccttatgtatgtatttgtttcagtagcagaccccccttttttttccaaccaaaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccagacgcaagcctagatgtgctgatgcctaaatgtaacatgaactaccccagtaaatagcacagtgcatttatgcgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctctagtttttgtgaaatgaccataaaaaagtaaaagcttttggcctttaatcattgagggtgtcaggaacagaatgcaaaattctacattttcagaattttccaagaggaatcatctgtctttcctaccagcctgttggtgcttccatctcaaagctgatgtctacagctcctaaccacttgaagtgtgctctttggaccagcagcatcaacatctcctaggagttagttagaaatgcaaatgatctggccccactcatgacctactagatcagaattttcattttaacaagatcccaggagacttatgtgcacagtacagtttgaggagccctgctataacctgcatttgaatggcatggtctatttaaatcttaattaaagaggcagccttaagagatataaaatatttatgtcttacagtgacatcatgtcacacataaatttaattacacaaattcaactctatacccttaaaggtgagaggaattttttttcttttacattttactctgtgatttctccttgcctcctcttcaaacttgcccttgacctccacagtctcagagaggagaaggccgcagtctaaatgcaaagtgaaaacaaaaaaagctgtttttttgcctttgacagtaaaggctcaggtccaggggattgggctgcaactggattttattgatgactttggaaccttaacctccagtcgagtacaactccactcgaatgcatttcacatttattatgctcttgttcctctcaaccatctggggtacatggcgtgatgttaagggaatgggctgccttgagcaattcagtatgctccgggtcacaccgctggaagtgctctgcaaatccattgtcgaataggaataatggcccatgtggattgttttccttccattttcctctcttctcaacctcttttgccatagtttccctttctcatttattcttttgtgcgctaaaacttaatactgaaaattggcaacccaaggcggatgtaacacatggctaggttttctgtggcttcctgattcataggccctctcattgccactttaaaaaccaccacttttcaccctgcaccttggggaaaaaagctcttagacataatcgatccctgggcccagaagaacaatacttaacaagttttagaaattggtaactattcaagtgatcctacacattagtcctgtttaccatattcatgcgggccaatatttaataaaaatgaaatggaaagttttctctggataggatccaccataataacagaacggcatgggcttacctctgtgagtgaaagccctttccaaagtcagtgatctggtctccaaatttctgccaatgccttgctgtgggccctcagatgagtcacgtggccatcaagggccccaatgtcctcatctcaaaaatggcagggagttctgaggggcttaggatgaaataatacctaagcccttttccaattctgaaattctttgacttggtatttccattttgtaattttcaccatgcatgctgcagctattcctcttcggggcgcaagtatttccctcctccaagtgatacacatgtgactgaggtgctagggacatctgaatgactcaccagaatgccagtgggggaggactggtcatgctgagctgttccccatgtgaaaccagggcctgagcactcttggggtcctgctgtggttgtcatgcagtcactgtgctaatggttttgcttttgcattgcaacccattgccatatcctcctctgagcatctcctcactctaccctcttctgatttggttaaataacttcatggatctgagttttgcacagttgagagcagagttttcaagaagcacactgcactgtgaacgcagcttatggtcatcaccctggatgaaggctcacaggattcctggtaccgagcacattggcagtgcgggtctatgagcactgggctttggataatccctctgagcctctaagagcattttctcacctgcaatatggggataatgataatagatagctatgtgtaaggctgggagattcaatggtgttgtggaaagcagtacagctgccaacatttacagagttcttgataaatggtaattgtgtctacttgtcttccttattggtggatgaaagaatctgaggctgagatatagcctcagaacttgtatgggtctgggaagcagcagaagtggatgagtaaaaacagacccagccacacccaacccatagtaacacccatttctgcaaccagaactggccctgatctccccactgtggggagggaaaggaaggaagggaaaagcaaggccagaggacgaagaaagagagaccagtcatagaatgtccagggctggaagtggccaaggctcacagctagtattggtgaagccagagttagaacaccagtctcccagctccaagttgagttctaaataggaaccatacttcctattacaggggttttccttcttctgtggtcattgtatacccaggtcactatcccagcctactctttcttggcaagtctgcacgggactgggctccagtgtcaatgtgtgactctcctctaccacatccctgatgtgagctgtccaacttcaagtcaacctcatacagaaatgaggaactcatcgtctacctatgcagcccattctcttcccatctctcgttattaaggacgtctttgtattagcctgaagtctgtgcagtgcctcccgtaccacagagagccccagacacagccacacacctttgattcattgagtccaggaatggcctttgcagagctacaaaggagaaatagtgagagatgcatatgaagagatgagaggaaggagagagagaaagagaaagagagaggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttcctgggccctttttctcagaaaaaccccctggctgctcacttccggttgggtccattagttttcatgctcattttttcttttcctgtttttctcttttcagcttcaaagaagcctcttcctcctactcctgaagacaacagggtgagtgagagcgctagctccgggtgcaggtgggcccacaggctacctgattggcatgttcctatttgcatgtccccctctccccatagttttcaaaccctggctgcatgcagcaggctgtcatgattcagcagaactcaacacattgggtatttttgggcttgaactctcttggggggtctgtccacttaaaggaccattcagctgctaaatctccatctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactgcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttccaaggccattcagcaacttagtaggatgcaaggtttctggcgtggtggtctttaactcgagtggtggttctcaaagtatagtccatggaccagaagcatctgcatcacctgggagcatgttagaaatacaaattcttaggccccacccccagacctgctgtgtccaaaacgctgggggaggggcccaggaatctgcattttaataagcctcctcactgatctataatatactgacttacaagtcttagatggcatagtacctactctagggcagcttattttgttaaggagatgaaaaaaaaaagatgggggaaaggatcatgacctttaggtagggaatatgaccctgaccttatgataatattaacaccaatatccacttttctttcttttttttttttttttgagatagagtcttgctcttgtcacccaggctggagtgcaatggcgtgatctcggctcactgcaacctccgcctcccaggttcaagcgattctcctgcctcagcctcctgagtagctgggattacaggcgctcaccatcatgcccggctaatttttgtatttttaatagagaccgacttttaccatgttggccaggcaggtcttgaactcctgtcctcaggcgatcaacccacttcaacctcccaaagtgctggaattacaggcgtgagccactgtgcctgaccaatacccacatttgagtactcgctcttcattccagagcaagttctttaacaagagctttcagattccatttcctcatgcttcttcctgaagaatgagctctgccttttttcccttcagccaaaatggtgacatttcaaaactggcagcgtccccataaaggaagctctaaatcctcaaagccccagcctggtgtttagatctgtcatcagcctactccctcacaacatgagagaaatgtactgaaactgtagcagagaatgagctctctctccttttctttcactgaccttctgcagactatttcaccatcccctttgaaggcctggttcggaaccctactgccctcccttgcagacggttccctcaacagtcccgcctaaacccacacctcccatcttaagtgaggctgctcttgtgtctttatttttggtatcaatgaaggtgaaagccagaaaacactgctggtccttctctccctacactctgccatttggcttttcagccttcttggaggagcatcgtggatactgttttgagtgttctgaccacaaaggttttggaatcattgttctagtttcaaccgcatgtctaaatccaatgcaacggttctcttgtctgagccacttgaaatcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgtaaaatatccatggtcagagtgaaggacaatcctaggcctcttttgcctatggatacaaacaaggtcgtatatcacattgaagtacaaattccgattcctcttggccccctgcatccatgggaactcaagtcttcctcttacagtccctcccagtcaacccagggcttgctgaggggccactagaatgtgtctgcatgtgtcctttcttgctggctgcctactaaggcaccctatccctgccactgctacctgggctctctgtgagggcccctcagccccgtggagctcttcccacctggggccagcagaggtcctggggggtcaggttgtgctgaggcctgcagcagagtggtcaggaggcaggatcctcattcctttcatgcctcaccacatcatggaggctcccaaacaacccttcctgagcccacagactcagtttctccaaatgccatcccttgattttctcactcaaatctaatggttcccaaccttatcaaactcaatcctgccttttaatgacagatattttgtaaggttccttttgttatcctgaaaagaaatttataactaatataacatatatatacacaattttttaaaattaaagtacttaattaaaattttttgttgctttgagacagggtgtcactctgttgcccaggctggaatgcagtggtgcaatcatagctcactgcaccatctgtctcttgggctcaagccatcctccctcctcagcctccgcagttgctgggactacaggcacttgccaccacacctggctaacttttgtattaaacatactttttaaaaagaatcaacaaatgttctaactgtaatatttaaaaaggaaagaaaaataatatatataacaaaatatgtgtttctatataaatattgggacatgactgcactggaagacagaatgaaatagtcgaattcttgcactggcaggtaggatccattggatttggcatctcgaatgcaactgatacaaaatgtggtattgggactcaactacagcattaccaccagtgatataattttccaaaatgatgaacaactcttagtaaacttctgaaccaaagcatagtcttccctcaaagtacaaggtagttgcattcttgggaaatccagtactttggatagggtacagctaggatctaggctcaggatgttcttatataattactgtataagctggtttctcaccacatgaatgtttaccaggatattcgaaagttgtggggaatgtgggactctacagagcattttgcattaaaggcctatagcatacctcaaactgtgatgttcaaaataacccccatattccaagcttgcatgattattagaaaaaaaaatacatgtccagtgtgcccctacagaaaggtactatcataatttgagggccctgctctgacctttctcttcacagctattaaccaatgagttgacctgcagtgggatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaactgaaagatttcatgttgactgcatctcctttgccaagggcatgatgcatccagcagagaggctgctgcatataacatagtgcagatagagaaaccagcagacttttgtgaaaatcacgtggctgcttggaattcactgtggtcagaatttacctcatagaatgagcaatgtgatgaattccaagcactgatgtctttgtgtcatgttcagcgctgtaactctaactcataaagaaagtctaccagaggaaggcagactgtctccccagacaccccgatgaaaggaggcattttacctccttttttatgtctttgcttggttttgttgtctctcttccccagcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggtaagtcatctttgtggctgctgtccccgtgtttgaggtgtggtgcgaacaaataaaataccaggatgatttgtcctatctcccacagtgtaaccacagcactgaggtgggagaagagagcagaggcagaaggaagagggaggaagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtgaggctgaaggtacatcccattaggaagtgcttatttttggtgaaaagaaaatgtgtgtatagagatggtacagattgatagttatgttaggacgcatcagaaagaagacactaaagatttagttacaatcgcagtcattgaactagccatccacatgactcagggagaaaataaggttgtacaaatactactttcccactatgcaacttttgaatgaaaaaaataccaagcatgagattcacactgccttttaaggtttttttttcctcttaatatatccgatgtattaacccatgctctggaatattttccagaatctgagttcaatagttgcatcaatccagccataaatgtactctaaattgcaaattcccttgttgaacacttaggttatctccaatattttgcaaatattaacaacactgcaacgaacatctttgtatattaatattaggggtttaaatgttttcaaggtatgaggttattattaattttaaagtataaaaaagaaaactgtccttgcaacatatagatcatttatgtcaacattttacttaactaacagtagagagaaatatacataaaaaataagccaccctccatttgcccccacatcaagtccaaaagtaatcactatttggccgggtgcactggctcacgcctgtaatcccagcagtttgggaggccaaggtgagtgcatcacttgaggccaggagtttgagaccagcctggccaacatggtgaaaccctgtctctactaaaaatacaaaaattagcatggtgtggtggctcaagcctgtaatcccagctactccactggctgaagcatgaaaatcacttgaacccaggagggagaggttgcagtgagccaagatggtgccacttcactctagcctgagcgacagagcaagactctgtctcaaaaaaaaaaaaaaagtgatcactattaataccttcttgtgtatcataaataaaagttatacctgtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggtgggctgatcacctgaggtcaggagttcaagaccaacctggccaacatggtgaaaccccatctctactaaaaatacaagaaattagctgggtgtggtggcaggcgcctgtgattccagctactcgggaggctggggcaggagaatcgcttgaacctgggaggtggaggttgcagtgggccaagctcacaccactgcactccagcctgggagacagaatgagaatccatctcaaaaataatcataataataataattgcacaatcttagaatgtatgattgtattattagtatttaaataatcctttatggtgagacatttagttgccagtttatttgtttcctctgctgtttcaaacaaggctttaatgaagatcttgtattcatgtatcttggccatctttggaatacaaacatatatatatgatatatatttatcacattagttttccttttcttttttttgagacagggtcttgctctgtcacccaggttggagcacagtggcactctcacagttcactgcagccttgacctctcaggctcaagtgatcctcccatctcagacccctacagagctgagactataggcacgcaccaccatgcccagataatttttgaattttttgtagaaatggggtctcattatgttgcccgggcttgtctcaaactactgtactcgagaaattctcccgctttagcctcccaaagtagttgggattacaggcataagccaccatacctggcctatatgtcacatttctaactgtgcaacagttaagtcagagtatgtgatatcttaattttgccacataatttcctcacaaagcttgccaaatttaccttcctgctaacagagttatggaagtgccaagactgggtatcattgaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattcatgaagacaattgagctagtcacatcaccttctctctgtccattatagacaggcccatatccgaaataggttcaagactgtctacagggtctacaaacaccgaagggacctagaaattcattagttcaatcaactgactttacttagcacacctaatgtaccaggaaatttgttctcctaggccttacttccccaaatgagagttaaacccttcatttggtgacctgtggaaaggcttaactatgcacttcaaagggcatcaaagaggacaccccagcagccagtcagcattatgggaatttccccagtttgctttgtgatagtgtggtatagtggaaagcacacaagatggggagacagaggacttggactttatcagctactcttgtcatatgaagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatatagtttaagcccttcatttgacgggtataaagtcagaggtccagagagtagaagggatgccgctttcaccctgtggtattaaatgagataatgaatgtgaaagtgctttgaaaactacaaagttatacacaaatgtaaagaagtttgatattcttattttgtttattatgttttttgtttatgcacaattattaattcttgctcaaaagtgactcctgatccccaaatctagcctggctttatcctttttttctcgtgtttataccgttcatatctgaagaagctcaattagggaggccttaaattaaaaagcttacaatgccaactggtagtgtcttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattccttttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttgtgtgtgtgtagttttagtagagacagggtttcagcatattggccaggctggtctcaaactcttgacctcgtgatccacctgcctcggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtgggcgtgtcagatgagcacagaagttggctctaacaggctccatttgatgaaatctgggacaatttgagtatcaaaataaataatgactattaaaataagtaatagactacaaaccattgaataatataagaatctgtaataaatagatagactgatagataaataaagaagtaaataaataaaaaggaaagggttttttcttatagtagaatgccaactaatgaatgataaagtttaaaaatcatcattttgtaacccagagtatcaactgattcaggcaagaatcctcaatgaatgtcaccactagcaagttaaagtttgatgagctgtggcatatttacatagtctcaaagtatctcctcacaaatcacttgtaattacaaagtggaggtaactagcaggcccgtctgaaacagtcaatccaaatgcacataaataatggagcaaaaaggtatcttgtgtctccttatgtgatgcactgagaagggcacacatcacttctgtgatattcctgctcaaaaaatgcacaacataaatttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtggttagataagtgtatactctgtgtcttaggaaatagacacagaagtacttaggaataaaagtcaattctcaaatagttcagaagaaaagtcaatctatgtctatctaaagagaatagtaaagcaaatgtataaaatatcagcaattggctcatctgggttatgtgtatatgatggttcttttacactattttacagcttttctgtaagtttgaaattatttaaaaattttaaaaaattaattactcactaaatataagataccaggcctaaagaataaagctaatgaggacacctattaacgcattagggttcttaattcaaatgtggtcgtgttatttgttgctgaaattctagtagattctttagtgaagaaccgtcattttctggagtctctcaaccttgtttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacaataagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttggtaaattgaatggattcaggtctcctgccttggtttgcagccatgaccttgggcaagttacctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttataatgttcaaaacctctaacgaatccatgaattcctttagtcatggctactctcaagtagccaaacaagtttgttaagtggtattccttccctacccagaacttctctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacaggactagcaaaccacaggataagaaacctgggcttggcattgacgtggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgcatagcaggaccgattttactcagggatgtcaagattaagggcgaaagggaagagaaaagtagaaaagatggtatggtggggcaggtactgggctctagttcctgttatgtcaccaactcattgggtgactttggggacctctcttcttccttctgggcctcggtttctcagtgagtagaagggcagaattggattaagtcagggatcacagttacccagccctcatcctgccactttctgctccttgtcctgtgaccaacacagctgatctcagtccatggcattgggactttattgggaaacaagacaaatgcagaaaaaagagcaagggaataatctaaaataaactaaggtaaactccagaggagttgggaaagattccatgaagaaaaagaagttgagctgagtccttactgaactctggtctctccttggctctacatcaactcagcacttaattatttcctgtgggttccccaaaaaaacacacattagaattgctgggaaatgttcaaaaatacagattcccaggtcccaccccagatccacagaatcagagtctctagtgttagttcccgggaatctgtactttctcaagttaaatttacaatgcaaatgtagccaactcaaacctggcgctgccaggctgtgttattggataacaaagtagaacttgattaatatgaactaattgagtggagtgcaaaattagctaaaactctgaattacactgtgtttaaacaagtatagttttgttatattaatcacacatcagttaatgacgtctatggagcacttcaaacagcccacattaatgacttctaaaagatgattcctgtattacagcagttcttgtgaggtgctaagtgctaagtacattttgcttgctctggcagttgaaacattcctccttactgatacatatatatatatatatatatatatatatatatttttttttttttttttttttttttttttttttttgagacagagtctccctctgtcacccaggctagcatgtagtggcatgatctcggcttactgcaacctccgctgcctgggttcgagtgattctcctgcctcagcctcctaagtagctgggattacaggcatgtgccatcacacctaactcatttttgtatttttactagagacggggtgtcgccctgttggccagactggtctcaaaactcctgacctcaggtgatccgcctgccttggcctcccagagtgctgggattacaggcatgagccaccacgcccagcctccttactaatattttgagctactttaccaaattctcttctcctccttaggtaaatatgagggcaaacatcaatgggtccctgtcagactcagcccagattctggatagaattgaatgacattttcttgctatttttcactttttttgtgtgctgtttttgaaacaatagctgtattatttctaggtgtatttagagtctttttatctaataagtataggacctttaagagatgaattcctgcatagtattccatggcgtatatgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaatccttttaaacccagagattctggaattcaaacaaatagcatgggccactgtctgtgtgtgtacacagatatgtgcccacaggcaaaccatcattttagttgtgggatagaaggatttgtgttgttgtagtttctatatactttgttccttatactccaagtgtatgccctccgcacaaggatcttgtctaactctgacctttacttagggccctcattgtgactaagttaagtgaatcataatatttggcttaacaaatgttaccagtgcaagtttacagcggggtaggaacagagtgttagataggaagtacttaaaatagacttcagattttttaatttccaccaagaatgaataaaatggtatgtccatttattagtgcttatttcatcagtgctggcaaaactgtcagggtggcgaaagttacattctcagggcactcccttcttcccacctctctcatgaaaccaggagcttaatgttctttttccttccgccctgcagccaaattctcattctggaaagggcctaagaaatatattatcattaagagaatccttatacactgttggtaggaatgttcattagttcagcccctgtggaaagcagtttggtgatttctcaaaaaactaaaaataaaattattattcaacccagcaatcctattacagggtatatacccaaaggataataaattattctacctaaaagacacctgcactattcataatagcaaagacatggaatcaacctaggtgcctatcaacagtggactggataaagaaaatttggcacatgtacaccatggggtaacatgcgccctgaaaaagaacaaaattgtgcattctgcagcaacatagatgcacctggaggaattatcctaagtgaattaacacaaaaatggaaaaccaaacaccacatgttctcacttataagtgagagctaaacagacatcaagatagtaacaatagacagtggggactccaaaagttggaaggaatggagagtggcaaggatagaaaaactacctattgggtaatatgttcactatctagcaaatgggttcaatagaaacccaaatctcagcaacacgcaatatgtccatgtaacaaacctgcacacatactccctgaatctaaaaaatttttaaaagttatatattcccattaagacactgatgaagttttcaggacagttttgtgcctttgtagggaaatggagaagcagcttctaacattctttgaaaggaggcatcctggagtagtagaccaaggctgggctttgctcacataccagagttcaaatccgaattctgtcactttctagttgtgggtcgtgggaatgccacttaagctctctggcactcagtgtcattggcggttaaggataccaatatccagatggcaatattgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctgctcataaaactacctaccattaactgagtctttattatgtgccagaaaatatgcagaccatttccaatcctaagaagccctgaaggcaggtattactatgctcatttcacacagaagaaaccgaggttcaggagctgatggtgcctccctatggccgtgggtctgaaggggccaagccacatccaggctccagccaactggactgcaagatccttcctgcttttctgcccctctgtacctgtttcttctctgtaaaacaatgcctaagaacctatctaggtctcaaattcccttctaattagaacatttgttagaactaagctgtttgacaatgaccaaagtgcagtcagaattaagagaagagacaaataatttttaaggtgtcttcggaaaatttttttggaagactgaggatgtgagcaggacgtggagcaagggcaggtggcaaagaggaagggcccgatccagggataggagggaacacagtgtacatcacagaggggccgtgcctctaccatggctgggagacagtaaggaggtgacctgcaaccccacaggtatgacggagaagggatgaaacaaagtctgtgtcgaggctccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacgtgcttaattccgccagcaacaagttgtaaccacacgttagcagtctaccaggggagctcattagagactcagtacccaaggcttttattggaggctgtttccacagacagcccctgcctagcacatgccaaagttccagatacccaaaaggaaaacaagcgttcaccataaaacacatgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatgaagtcaaataagggtgaaggggtcagagaggctttctcaatgtatgctgacaatcagttaaattcatagaataggcaaggcaaacacatagcaaatatttccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaacttaatactcgtagacttttttgtgtctcaacattgcttcttaataatcattacatttgtgtttcatttgtttaagtgagaacaatccctgtataaagcattatcacatcaaggaaacaaatgacaatcctaagcgatactatgtggctgaaaagtatgtgttcgattccatccctcttctcatcaactatcaccaacataatggaggaggtaagctctagagcaggggtggacccgggccgcccagcaggaggtgagcagcaggtgagcaagcattactgcctgagctctgccttctgtcagatcagcgtcattagattctcataagagtgcaagccctattgtgaacagcacttgtgggatctaggttgtgtgctccttataagaatcaaatgcctgatgatctgagatggaacagtttcatcctgaaagcaaccccctgccacatccctccatggataaactgtcttccacaaagccgatccctggtgccaaaaaggttggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataactcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttcttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatcccgctaattttggtattttttgtagagacagggtttcaccgcattggccaggctggtcttgaactcctgacctcaggtaatctgcccgcctcagcctcccatactgctgggattacaggtgtaagccacagtgcccagccagggattacatttcaacatgagatttggaggggacaaacatccaaactatatcagcacccacacaggagacttaatgaaaactggcaaaagctcgccctggcttctttttgactataaataataaataaatatacaaatagaaaaatatgacaaatatttaattatattatatatcttctattagcaagctatcttgtggaaataatggaattttaccacttgcccatctgtgcttatgatgttttcaaggaggatatgatatcaataattaggctttgggatttgttttccagaataaaattagcttttgcgtctgatgatgattattattttttttagtgatttaagttagatggttgctagagcaaagccctaaccactgcttcttggcttttcaatcaacccaggcctggtgactcgactccggtatccagtttgttttgggaggcagaaagccccagttacagcagggctgagatacggtgagcagtacaatcaggaatgtaaactcatgtccctaaaggtctggggcaaattctgaataaactggccatgagcctacctgttcctcagactacaaatcaccattaaaacaagtgtattatatatctagagatgatggcactaatgaatatttacattgtgtgtaagagaagtacatatacaagcacatttctctaggtcaaaccagtggccattggttttagtgaagagttcattaatgaagtgtttattaagcacctactttgtacagagcaccctactaaatgctattagaaaaatattagaaaaccatgccttagcactgtgtttccacctatcttctagaacttttatatcatctagttggttgagtagcagactattgccagaactgcaagttgagagcatctagaagtgtttctctgcataagagagtgttaaaattctttggaatacctttaggcgtggcatgatctccagtgccgcagcccctactatgttttcttgccctacggaattgcttcactcacttgggattacctgcctggactctgaaggcatttggctttgcatcccttggtcccaactgtgtgctgcctgtggagaaggctggtctaattttcatttcttatctcctagcttggtggttctcaaatttcagtgtgcatcaaagtcttctagaatgcttattaaaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagcgatcctcccacctcagcctcccaagtagctactatgcctggctaatttttaaaaattttttgtagagacagggtctcactatgttgccctggctggtcttaaactcctgggctcaggcaatcctcctgcctcagcctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaataaatgtagaatcttgatgtgtccgtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttacttagtgtgaaaaatgacatagaaaaatgggacattgcaagaaccctttctttaatattttgattaatatggtttctttaatatcttcattaatgccactctccttctttccatgttaccttcccacacatattttcatagttttctagcatatcctatgttattatgtgggaaaaagataatttatttgccatctttgaattatattaacaataggctaaaattctagttagggctttatagtcccctggtatcccaataccttatatctactgcttgctgaccccagagaactctctctctctcttccagggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgtgagtgctcagaacaaggatatgcagaaactctggggggaacatcggttcagtgttcttgaaatgccattcaaacgccagggggtactatctccctgcgcaaactcccagcagtggcttcctattgcacagagaatacaatcaaactcttcacagtggtctccaaggcccaccataatctgatcatgcccacctcccccttctcagctcctacccatctctcctccagtccatgacatgccagccacactggcctctgctcatcttcacacacacagctgactccttgccatttttcaggtctcagctccaatgacatgtttttgttttggggagggaatgaatattattttcatccaaaccataaattagacaaaatgaccattggctattttggtaccataatattttcggcatttttgggagactgagtttaggccatctcaccccttgtctttttcctccaggaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggtatgagcatgcagggtgaacacccacaggtccagggtaaagggacagttctcactgaaatgactgggaacgcattaataaataatacattacagataatctcctttcctttctcaacttctcccttccttcacctactttgggtggtcctagtggaaagggcttcatgaggacttacttctgggctctgatcccagcccaaactctttcacctcctgcatttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccgtatgatttgtatgcacattaaaatttgagatatgcagctgggtgcggtggctcatgcctgtactcccagcactttgggaggccgaggtgggcgaatcacgaggtcaggagttcgagaccaccctggccaacatggtgaaaccccatctctactgaaaattcaaaaaattagctgagcttactggcgggcacctgtaaccctagctacttgggaggctgaggcaggagaatcacttgaacccaggaggcagaggttgcagtgagctgagatcaagccactacactccagcctgggtgacacagtaagactccatctaaaaaaaaaaaaaaaaaaaaaattgagacacactggagtgttatctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttgcctgtctcctctccaggctgccagaaattgtttggtgggagaaaaccaagtcatcaaggtgtctgactttgggatgacaaggtaaaagagggatgtggtgccggtgaagtctcaggaatgggactgaggcccccggaacattctgaccttctccctccactctcttcccaggttcgttctggatgatcagtacaccagttccacaggcaccaaattcccggtgaagtgggcatccccagaggttttctctttcagtcgctatagcagcaagtccgatgtgtggtcatttggtgagtgtcatgctgggccccactgccccatgatctgggcttcaggccagctgtttcctttatcaaatgcagacaaccctacccacactgaaccctgtatcatatcatgagggtgtcccactggagggttgtgtaagaaaggccccgaaaactatgaaagggccttcatcattttgtttgtttttagagatactggacatggtggtgggagttaattaaaagtggaaacaagagttctggtgccagctgctgtgaagtcaaaagctggagaagtcaggagattcaaatatgagccccttgaaggcagggaccatgttttgtccaacactacatttccatacttatctctcaataagtattaatatttattcattcattcaacaacaattaactgatcatctattctatgccaagggctaatctaggtgctgaggatgcagtggttcatagaacagaaaagacttctgttcttttggaactaaatttgagatgggaggggagacagaaaatcacaaaagatcataataacagtcataaacaataataataataaacaagctaagggatagaagataaagccaggcaatcataagtaggtgctatgaataaaataaaacagtaatggggcagagtgactaggatagagagagggtctgctttgaatagtgtggtgtgggaaggcctttctcagaaggtaattcttcagcagagacttgaatgataggagggagctgtcaccatttgaagagccagggaacagtgtccctgacagagggaccagcaagtgcaaaaacttggtgcatccaaagaacaaggggtactgacttattgggagaacaacaggcaatgaagctggtaggccatcataaggaattagaatttctaaaaagtgcaaatggccatgaagggatgaatgatgttggtattgcaggatgtgccaaatgttcttgctggatttgccatgtcacctgaagtcatagtttgtgcatactaaagtgtgcaaaaaaatataccagacaacctctttgatttggattacaagaattatactgtggacagaaactacttgaagattgatttttgccattcggtatgaaggaagggtttgacaagggcttactagtagtagaaaccaggggggagtttggctaggtaaatcttttaggagaagaatgagtgttaaaaatcttctgcagcattttagtctatccatctctaggagccaagtggtttgttcattatgagtcctacctatttcttaaaacagtaccctattaaccaacccttgcagctactttgttaaccaggtttaagttacagaatggacttgaaagaaattgtactaacagcatttttggatgactcccctctccccagtgtgtataactaggaaggttggggctgatgtgcagtcatctcactatgggtgatgaaactgatcacactgcaccaagcaagcaagggccccacaatgagacatttggagcaatggccactttagcacattcaccttctgactctgaatggggtttattcagccaaagggtgtcagcctgggaatttcctggggcatattaccattacagggttgggctgaaattagtccctgtctaggatatattatctgaagagagtccagaaatgaggttgatggatggatgcagaattgagagatcaatggaaaaaagtgtgaaaaaactgggggtaccagcctaagcaacagaaacctggatgagctgaaaactccatgcctgcatcagcccattggactttgtcctacgttttaagtttctttgccctaattagcagtgtgctattcagaacaagtcaacctctttgtactttgctcaatttttttatctatacatttctcatctgtgtattaaagcaatcattctgaaaccatgtttcagcatcggcacattttcaaaaaaattttcactaaaaattatggtgtcttggggtgataagcattcttatttagggtcaggttctgaatttccaactcctgaggcacctctgagtaacatctagagattctgatccactgggtttgggctagggcccaggaatctgccatttgaacaagactctgagatgatttttattcaggtgttttggggatcatgctttgggaatgtctactctaagattctctggaacaacctttgaaaagctctgaattagctgatttgcaagcagccttcttgctctgacaacctgtgaatatatcagcacatgataaagacaaagctaggtgtcacatttctaccaagggcagaagaggaaaagaaagggattaaatcagaggtcaaaaatagacaagcaaaagatgtgttttgcttggtctacatggcattttttaaattcaagaagttcaactcttaatttttgacgtcttttttaaaaaaatcagaaaatgtgccaattctgatccctcattttcatgtgccatactttggttggagtcaaatcatagctgtctccttaagacagaactgtttatctcattttccacaatcctccccaatcccaatagtgtcacacctcctgcactccattcatttacatcctgcatcttggcatttgagtctacaactcttagttgtagcatttgagtttggtacaacaaagggtccatcttgaaaatccttctccactacaaaggttgggaaatttcagttctttaaaaataggacaggcctaataagcctcaggtagacttgatgcacttctggaggtagcacatgaatcctaatgcaaggagtctgtaatttctagaggcaggttggtttgtttgctgtctgtgggctttgtcattcactgtgctgtgctcaccatttcttgtaggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagaggtcagtggaggaagtgcttccccatgcattgtcgtatacaatttgaggacctccctccttccctagagaaaggaaccctctcagaaggatgaggcaggagggataactaatatagattagcaacaacatgactttgaggatctgttaacgggatagatcccccatccctaaaggagctgaaggcgaccttaaatattatttggtttgctacataatgtcacaagctataagcatagcttcagagaggaggatggggtgtggcctatgccagcttccttctcgattttctgagaagagaaaaaaagtctgtaacatcataaaaccattaaaagcacaggaagttagttctataacttggggaacaaagttcacttgcactatgaaaatattaaaatggcttaatttgagttcattttattcattctgcatttaaaatggggagccaattcctctgtacccgcccaggtggctcatttaccccaaccttggattgcaggccatggcttgagccccatcactatgagtcttagtctttgctgtctttgctgagttagaaaatcatacatttcagccaaagtggaaagttgctgaaacagagaattaataaaaattctgatcattgtacgacaacaaggtggaatacaaaaaatttggaacactaggattttgtctcagctttaccatttatttgccattaatctttgacaattctctgaacttcctttttcttactgttaagagaattaaataatgcttggtctgtgagttcatagagcttttataatcagaaacaaagaaacaatagagacataaaggagggcataaaacaaatcttatccacttcataaggattagctacaataataataatgatggctgacattcagttggcactttttccctcttttaaccatcatttattgatttttttaaattaatagtctttattttttaacaaagagtacagagttctcatatgcccacctcacctgaacagtttccctgttcactaacatttggcatgagtgtgatacatttgttacaattagtgaacctctattcatacattaactaaagttcatagtttacattaaggttcagtctttgtgctgtagagttctgtaggttttcacaaattcatgtatccatcattatagtatcagacagaatagttttactgcactaaaaatctcctgtgcttcacccatttatccctctcctcatccccaaaccactggcaactactgatcttttcactgtcttcatagttttgcctttctcagaatgccatatattggcatcatacagcatgtaggcttttcggactggtttctttcatttagtaatatgctttaaggtccctccatgtcttttcgtggcttaatagctcatttctttttgttgccaaataatattccattgtatggatatatcatagtttatttatttacctaccaaaggaaatcttggttgttttcagtttttgtgtttgtttgtttgggtttgtggggttttgtttttttttttgagatggggtcttactctgttacccaggctggagtgcagtggtgcaatctcagctcactgcaacctctgcctcccagtctcaagcgatcctcctacctcagcctcccaagtagctgggaccacagacatgtgccactaggcccagctaattttttgtatttttggtagaaacagggttttgccatgctgcccaggtgagttcaggcaatcaatccacctcaggcctcccgtagtgctgggattataagtgtgagtgctcaggcagactggtttccttcacttagtaatatgcctttaaggtccctccatgtctttttggcttgatagctcatttctttttattgctaaataatattccattgtatggatatgccacagtttgtttatctatttacctgccaaaggaaatcttgcttgctttcagttttaaacaattatgaatacagctgctataaatgtttatgtgcagatttttgtatataaattttcaactcaattgggtaaatgcctaagagtatgcttgctgaatcatatggtaagactatgtttaactttttaagaaactgccagaatgtcttccaaagtagctgtattattttacattcccaccagcaatgagagttccttattagcattcattgttttggatttcagtggttctaatagatgtgtagtcatattacattgttgttttaacttgcattttcctaatgacatatgatgttaagaacattttcatatgcttatttgccacctgtatatcttcttggtaatatctattcagatcttttgcccatttctcaatcaggttgtttgtttacttattgttgagttttaagagttctttgtatattttggatacaagtcctttatcagatatgtgttttgcaaaattttctcctagtctgtggcatgtcttctcattctcttgacagtgtctttcacagagaagacttttcaaatattttaacaaagctcaacatcaacttatttattcatgaattgtgcttttgatttacatctaaaaactcattgccaagcccaatgtcacccaaattttctcctatgttactttttattttatggaagttttataattttgcattttacatttaggtctatgatccactttgagttaattttcctgaaaggtgtcaggtctgtgactagagtcattgttttacatatggatgtccaattattacagccctgtttgttgaaaagactataccctttctcctctgttcctttgttaaatgttagtttactatatttatatggatctatatctgggctgatccattaatctgtttgtttattctttcactagcaccatcctctcccattactgtagctttagagtaagtcctaaagtcaggtagggtcagtcttctagctttgttgttcttcttcattattgtattggctctctgggtcttttgcctctccgtataaatgttacagtcagtttgtcaatatctaaaaaaaataacttgctgaatttttattaggattatattgaatctataagtcaagttgggaagaactaatattttaacactatagtgtcttcctgtccatgaacatggaatatctgtccatttatttagatcttctttgctttcttttattagaatttttaattttttctcatttagatcatgtagatattttctgagatttatacccagatatttcattttttggtgttctttagcattaatttcttgatatatttttatatgtgatttattgaattctcaaaacaatttcatgaggtagatactattattatctccattttacaaatgacaaaactgaggttcaaagaggttaaataacctgctgaatgtcacacagctaattagtggtaaaactgagattaaacactagtcccttggattccagaatacctgctgttaacaactaggacaatgtatatggaatacagtcaacatggaagcacatacaaaaatccacaggggatgctgctattaaattctggtttgttttggatttacctatgacgcataagtacaaggaacttacagagttcttttttccctctccagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaat
